(12) United States Patent
Liu et al.

(10) Patent No.: US 11,473,077 B2
(45) Date of Patent: Oct. 18, 2022

(54) ENGINEERED TYROSINE AMMONIA LYASE

(71) Applicant: Codexis, Inc., Redwood City, CA (US)

(72) Inventors: Joyce Liu, Fremont, CA (US); Nikki Dellas, Mountain View, CA (US); Stephan Jenne, Foster City, CA (US)

(73) Assignee: Codexis, Inc., Redwood City, CA (US)

( * ) Notice: Subject to any disclaimer, the term of this patent is extended or adjusted under 35 U.S.C. 154(b) by 250 days.

(21) Appl. No.: 16/705,656

(22) Filed: Dec. 6, 2019

(65) Prior Publication Data

US 2020/0190499 A1 Jun. 18, 2020

Related U.S. Application Data

(60) Provisional application No. 62/779,647, filed on Dec. 14, 2018.

(51) Int. Cl.
| | | |
|---|---|---|
| *C07K 14/00* | (2006.01) | |
| *C12N 9/88* | (2006.01) | |
| *A61K 38/51* | (2006.01) | |
| *A61K 31/122* | (2006.01) | |
| *C12P 7/42* | (2006.01) | |
| *A61K 9/48* | (2006.01) | |
| *A61K 9/20* | (2006.01) | |
| *C12P 13/22* | (2006.01) | |

(52) U.S. Cl.
CPC ............ *C12N 9/88* (2013.01); *A61K 9/20* (2013.01); *A61K 9/48* (2013.01); *A61K 31/122* (2013.01); *A61K 38/51* (2013.01); *C12P 7/42* (2013.01); *C12P 13/225* (2013.01); *C12Y 403/01023* (2013.01)

(58) Field of Classification Search
None
See application file for complete search history.

(56) References Cited

U.S. PATENT DOCUMENTS

| | | | |
|---|---|---|---|
| 5,444,468 A | 8/1995 | Fukushima et al. | |
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,251,674 B1 | 6/2001 | Tobin et al. | |
| 6,265,201 B1 | 7/2001 | Wackett et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,337,186 B1 | 1/2002 | Krebber | |
| 6,344,356 B1 | 2/2002 | Stemmer | |
| 6,352,859 B1 | 3/2002 | delCardayre et al. | |
| 6,355,484 B1 | 3/2002 | Patten et al. | |
| 6,358,740 B1 | 3/2002 | Patten et al. | |
| 6,358,742 B1 | 3/2002 | Stemmer | |
| 6,365,377 B1 | 4/2002 | Patten et al. | |
| 6,365,408 B1 | 4/2002 | Stemmer | |
| 6,368,861 B1 | 4/2002 | Crameri et al. | |
| 6,372,497 B1 | 4/2002 | Stemmer | |
| 6,376,246 B1 | 4/2002 | Crameri et al. | |
| 6,379,964 B1 | 4/2002 | delCardayre et al. | |
| 6,387,702 B1 | 5/2002 | Stemmer | |
| 6,391,552 B2 | 5/2002 | Stemmer | |
| 6,391,640 B1 | 5/2002 | Minshull et al. | |
| 6,395,547 B1 | 5/2002 | Stemmer | |
| 6,406,855 B1 | 6/2002 | Patten et al. | |
| 6,406,910 B1 | 6/2002 | Patten et al. | |
| 6,413,745 B1 | 7/2002 | Patten et al. | |
| 6,413,774 B1 | 7/2002 | Stemmer | |
| 6,420,175 B1 | 7/2002 | Stemmer | |
| 6,423,542 B1 | 7/2002 | Crameri et al. | |
| 6,426,224 B1 | 7/2002 | Crameri et al. | |
| 6,436,675 B1 | 8/2002 | Welch et al. | |
| 6,455,253 B1 | 9/2002 | Patten et al. | |
| 6,479,652 B1 | 11/2002 | Crameri et al. | |
| 6,482,647 B1 | 11/2002 | Stemmer | |
| 6,483,011 B1 | 11/2002 | Stemmer et al. | |
| 6,484,105 B2 | 11/2002 | Zhang | |
| 6,489,146 B2 | 12/2002 | Stemmer et al. | |
| 6,500,617 B1 | 12/2002 | Stemmer et al. | |
| 6,500,639 B2 | 12/2002 | Subramanian | |

(Continued)

FOREIGN PATENT DOCUMENTS

| | | | |
|---|---|---|---|
| WO | 95/22625 A1 | 8/1995 | |
| WO | 95/33836 A1 | 12/1995 | |
| WO | 96/00787 A1 | 1/1996 | |
| WO | 97/0078 A1 | 1/1997 | |
| WO | 97/35966 A1 | 10/1997 | |

(Continued)

OTHER PUBLICATIONS

UniProtKB Accession No. K9XQ92 dated Mar. 6, 2013.

(Continued)

*Primary Examiner* — Hope A Robinson
(74) *Attorney, Agent, or Firm* — Codexis, Inc.

(57) ABSTRACT

The present invention provides engineered tyrosine ammonia-lyase (TAL) polypeptides and compositions thereof. In some embodiments, the engineered TAL polypeptides have been optimized to provide enhanced catalytic activity while reducing sensitivity to proteolysis and increasing tolerance to acidic pH levels. The invention also provides methods for utilization of the compositions comprising the engineered TAL polypeptides for therapeutic and industrial purposes.

18 Claims, No Drawings

Specification includes a Sequence Listing.

(56) References Cited

U.S. PATENT DOCUMENTS

| | | |
|---|---|---|
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,531,341 B1 * | 5/2009 | Vellard ............... C12N 9/88 435/232 |
| 7,534,564 B2 | 5/2009 | Patten et al. |
| 7,534,595 B2 | 5/2009 | Vellard et al. |
| 7,553,653 B2 | 6/2009 | Kakkis et al. |
| 7,560,263 B2 | 7/2009 | Kakkis et al. |
| 7,620,500 B2 | 11/2009 | Mundorff et al. |
| 7,620,502 B2 | 11/2009 | Selfinov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | Delcardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 9,611,468 B2 | 4/2017 | Huisman et al. |
| 9,665,694 B2 | 5/2017 | Cope |
| 9,684,771 B2 | 6/2017 | Cope et al. |
| 10,221,408 B2 * | 3/2019 | Okhamafe ............ A61P 35/00 |
| 2006/0195947 A1 | 8/2006 | Davis et al. |
| 2008/0220990 A1 | 9/2008 | Fox |
| 2009/0312196 A1 | 12/2009 | Colbeck et al. |
| 2012/0177722 A1 | 7/2012 | Weiner et al. |
| 2013/0039898 A1 | 2/2013 | Okhamale et al. |
| 2016/0244787 A1 | 8/2016 | Chan et al. |
| 2017/0159038 A1 | 6/2017 | Huisman et al. |
| 2020/0190499 A1 * | 6/2020 | Liu ...................... C12N 9/88 |

FOREIGN PATENT DOCUMENTS

| | | |
|---|---|---|
| WO | 98/27230 A1 | 6/1998 |
| WO | 00/42651 A1 | 7/2000 |
| WO | 01/75767 A2 | 10/2001 |
| WO | 2008/069958 A2 | 6/2008 |
| WO | 2009/152336 A1 | 12/2009 |
| WO | 2013/138339 A1 | 9/2013 |
| WO | 2015/048572 A1 | 4/2015 |
| WO | 2015/048573 A1 | 4/2015 |

OTHER PUBLICATIONS

Altschul, S., et al., "Basic local alignment search tool," J. Mol. Biol., 215: 403-410 (1990).

Altschul, S.F., et al., "Gapped BLAST and PSI-BLAST: a new generation of protein database search programs," Nucleic Acids Res., 25(17):3389-3402 (1997).

Beaucage, S.L., et al., "Deoxynucleoside phosphoamidites—A new class of key intermediates for deoxypolynucleotide synthesis," Tetrahedron Letters, 22(20): 1859-62 (1981).

Black, M.E., et al., "Creation of drug-specific herpes simplex virus type 1 thymidine kinase mutants for gene therapy," Proc Natl Acad Sci USA, 93:3525-3529 (1996).

Botstein, D., et al., "Strategies and applications of in vitro mutagenesis," Science, 229(4719):1193-1201 [1985].

Caldwell, R.C., et al., "Mutagenic PCR," PCR Methods Appl., 3:S136-S140 (1994).

Carter, P., "Site-directed mutagenesis," Biochem. J., 237:1-7 (1986).

Christians, F.C., et al., "Directed evolution of thymidine kinase for AZT phosphorylation using DNA family shuffling," Nat. Biotechnol., 17:259-264 (1999).

Crameri, A., et al., "DNA shuffling of a family of genes from diverse species accelerates directed evolution", Nature, 391:288-291 (1998).

Crameri, A., et al., "Improved green fluorescent protein by molecular evolution using DNA shuffling," Nat. Biotechnol., 14(3):315-319(1996).

Crameri, A., et al., "Molecular evolution of an arsenate detoxification pathway by DNA shuffling," Nat. Biotechnol., 15(5):436-438 (1997).

Dale, S.J., et al., "Oligonucleotide-directed random mutagenesis using the phosphorothioate method," Methods Mol. Biol., 57:369-74 (1996).

De Boer, H.A., et al., "The tac promoter: A functional hybrid derived from the trp and lac promoters," Proc. Natl. Acad. Sci. USA, 80:21-25(1983).

Guo, Z., et al., "3'-End-Forming Signals of Yeast mRNA," Mol. Cell. Biol., 15(11):5983-5990 [1995].

Henikoff, S., et al., "Amino acid substitution matrices from protein blocks," Proc. Natl. Acad. Sci. USA, 89:10915-10919 [1992].

Ikeda, K., et al., "Phenylalanine ammonia-lyase modified with polyethylene glycol: potential therapeutic agent for phenylketonuria," Amino Acids, 29(3):283-287 [2005].

Kramer, B., et al., "Different base/base mismatches are corrected with different efficiencies by the methyl-directed DNA mismatch-repair system of E. coli," Cell, 38(3):879-887, 1984.

Ling, M.M., et al., "Approaches to DNA Mutagenesis: An Overview," Anal. Biochem., 254(2):157-78 [1997].

(56) References Cited

OTHER PUBLICATIONS

Matthes, H.W.D., et al., "Simultaneous rapid chemical synthesis of over one hundred oligonucleotides on a microscale," EMBO J., 3(4):801-05 (1984).

Minshull, J., et al., "Protein evolution by molecular breeding," Curr. Op. Chem. Biol., 3(3):284-290 (1999).

Needleman, S., et al., "A general method applicable to the search for similarities in the amino acid sequence of two proteins," J. Mol. Biol. 48:443-453 (1970).

Pearson, W.R., "Improved tools for biological sequence comparison," Proc. Nat'l. Acad. Sci. USA, 85:2444-2448 (1988).

Romanos, M.A., et al., "Foreign gene expression in yeast: a review," Yeast 8:423-488 [1992].

Simonen, M., et al., "Protein Secretion in *Bacillus* Species," Microbiological Reviews, 57:109-137 (1993).

Smith, M., "In vitro mutagenesis," Ann. Rev. Genet., 19:423-462 (1985).

Smith, T., et al., "Comparison of Biosequences," Adv. Appl. Math, 2:482-489 (1981).

Stemmer, W., "DNA Shuffling by Random Fragmentation and Reassembly: In vitro Recombination for Molecular Evolution," Proc. Natl. Acad. Sci. USA, 91:10747-10751 (1994).

Stemmer, W.P.C., "Rapid evolution of a protein in vitro by DNA shuffling", Nature, 370:389-391 (1994).

Villa-Komaroff, L., et al., "A bacterial clone synthesizing proinsulin," Proc. Natl Acad. Sci. USA, 75:3727-3731 (1978).

Watts, K.T., et al., "Discovery of a Substrate Selectivity Switchin Tyrosine Ammonia-Lyase, a Member of the Aromatic Amino Acid Lyase Family," Chem. Biol., 13:1317-26 [2006].

Wells, J.A., et al., "Cassette mutagenesis: an efficient method for generation of multiple mutations at defined sites," Gene, 34:315-323 (1985).

Zhang, J-H., et al., "Directed evolution of a fucosidase from a galactosidase by DNA shuffling and screening ," Proc. Nat. Acad. Sci., U.S.A., 94:4504-4509 (1997).

Zhao, H., et al., "Molecular evolution by staggered extension process (StEP) in vitro recombination," Nat. Biotechnol., 16:258-261 (1998).

\* cited by examiner ized. This form occurs in less than 1 in 250,000 persons
ENGINEERED TYROSINE AMMONIA LYASE The present application claims priority to U.S. Prov. Appln. Ser. No. 62/779,647, filed Dec. 14, 2018, hereby incorporated by reference in its entirety for all purposes.

REFERENCE TO A "SEQUENCE LISTING," A TABLE, OR A COMPUTER PROGRAM LISTING APPENDIX SUBMITTED AS AN ASCII TEXT FILE

The Sequence Listing written in file CX7-182US2_ST25.TXT, created on Dec. 5, 2019, size of 7.80 MB, machine format IBM-PC, MS-Windows operating system, is hereby incorporated by reference.

FIELD OF THE INVENTION

The present invention provides engineered tyrosine ammonia-lyase (TAL) polypeptides and compositions thereof. In some embodiments, the engineered TAL polypeptides have been optimized to provide enhanced catalytic activity while reducing sensitivity to proteolysis and increasing tolerance to acidic pH levels. The invention also provides methods for utilization of the compositions comprising the engineered TAL polypeptides for therapeutic and industrial purposes.

BACKGROUND OF THE INVENTION

Tyrosine ammonia lyase (TAL; also referred to as tyrase, L-tyrosine ammonia lyase, and "L-tyrosine ammonia lyase [trans-p-hyroxycinnamate forming]"), along with histidine ammonia lyase (HAL) and phenylalanine ammonia-lyase (PAL) are members of the aromatic amino acid lyase family (EC 4.3.1.23-1.25 and 4.3.1.3). The enzymes having TAL activity are currently classified in EC4.3.1.23 (previously classified as EC 4.3.1.5). TAL catalyzes the formation of p-coumaric acid from L-tyrosine.

Tyrosinemia (also referred to as "hereditary tyrosinemia," and "hypertyrosinemia") is a genetic disorder characterized by elevated blood levels of tyrosine, due to the deficiency of an enzyme required for the catabolism of tyrosine in the liver. If untreated, tyrosine and other metabolites accumulate in the tissues and organs of affected individuals, resulting in serious medical issues. Tyrosinemia is an inborn error of metabolism inherited in an autosomal recessive pattern. There are three types of tyrosinemia, each caused by the deficiency of a different enzyme. Currently used treatment methods depend upon the type of tyrosinemia involved. A low protein diet is often used.

Type I tyrosinemia (also referred to as "FAH deficiency," "fumaryl acetoacetase deficiency," "fumaryl aceotacetate hydrolase deficiency," "hereditary infantile tyrosinemia," and "hepatorenal tyrosinemia") is caused by a deficiency of fumarylacetoacetate hydrolase, due to mutations in the fah gene. This is the most severe form of the disease, with symptoms usually appearing in the first few months of life, commonly including failure to thrive, diarrhea, bloody stools, vomiting, jaundice, enlarged liver, the tendency to easily bruise, lethargy, irritability, fever, and other symptoms, such as a distinctive cabbage-like odor of the skin and urine. Some affected infants have repeated neurologic episodes of acute polyneuropathy, characterized by severe leg pain, as well as altered mental status, abdominal pain, and respiratory failure. Infants with the acute form are typically affected at birth and there is a rapid onset of symptoms that can lead to developmental delays, enlarged spleen, ascites, kidney disease, and blood clotting abnormalities. Untreated, it can lead to hepatic and renal failure, nervous system problems, and an increased risk of liver cancer (e.g., hepatocellular carcinoma). In some cases, hypertension and hypertrophic cardiomyopathy are present. If untreated, this disease can be fatal. In the less-common chronic form, the symptoms exhibit a more gradual onset and tend to be less severe. Affected infants initially exhibit vomiting, diarrhea, enlarged liver and spleen, and failure to thrive. Eventually, progressive liver cirrhosis occurs, leading to chronic liver failure, developmental delays, and renal Fanconi syndrome (a rare kidney disorder characterized by weakening and softening of the bones [rickets], vomiting, dehydration, weakness, and fever). In some cases, the most effective treatment has been full or partial liver transplant. Worldwide, this form affects approximately 1 in 100,000 human births (Genetics Home Reference, U.S. National Library of Medicine).

Type II tyrosinemia (also referred to as "keratosis palmoplantaris-corneal dystrophy," oculocutaneous tyrosinemia," "Richner-Hanhart syndrome," "tyrosinemia due to TAT deficiency," and "tyrosinema due to tyrosine aminotransferase deficiency,") is caused by a deficiency of tyrosine aminotransferase, due to mutations in the tat gene. It affects the eyes, skin, and mental development. As with Type I tyrosinemia, symptoms usually begin in early life, and include excessive tearing, photophobia, eye pain and redness, and painful skin lesions on the palms and soles. About half of affected individuals have some level of intellectual disability. This form occurs in less than 1 in 250,000 persons (Genetics Home Reference, supra).

Type III tyrosinemia (also referred to as "tyrosinemia due to 4-hydroxyphenylpyruvate dioxygenase deficiency," "tyrosinemia due to 4-hydroxyphenylpyuriv acid oxidase deficiency," and "tyrosinemia due to HPD deficiency") is a rare disorder, caused by a deficiency of 4-hydroxyphenylpyruvate dioxygenase, due to mutations in the hpd gene. Symptoms of this form include intellectual disability, seizures, and intermittent ataxia. This form is very rare, only a few cases have been reported (Genetics Home Reference, supra).

There are additional cases in which there are temporary elevated tyrosine levels, due to non-genetic factors such as vitamin C deficiency or premature birth, which results in immature liver enzymes. Differential diagnoses are used to differentiate these transient cases from tyrosinema I, II, or III.

In addition to tyrosinemia, there are other diseases associated with insufficient or absent tyrosine metabolism. For example, alkaptonuria also referred to as alcaptonuria, is a disease caused by deficiency of homogentisate 1,2-dioxygenase, which is an enzyme involved in tyrosine degradation. This enzyme is encoded by the HGD gene. Insufficient activity of this enzyme results in the accumulation of homogentisic acid. Excess homogentisic acid and related compounds are deposited in connective tissues, causing the cartilage and skin to darken. Over time, arthritis may result due to the accumulation of homogentisic acid and related metabolites in the joints of affected individuals. Homogentisic acid is also excreted in urine, making the urine turn black. Alkaptonuria is a rare disease that affects 1 in 250,000 to 1,000,000 people worldwide (See, Genetics Home Reference, supra).

Treatment of these diseases has largely been the life-long use of a phenylalanine-, and tyrosine-restricted diet. Treatment with nitisinone (NTBC; 2-(2-nitro-4-trifluoromethylbenzol)-1,3-cyclohexane dione; Orfadin®) has been reported to be helpful for type I tyrosinemia and alkaptonuria, due to its inhibition of the 4-hydroxyphenylpyruvate oxidase pathway. However, NTBC must be used in combination with a challenging and costly phenylalanine-, and tyrosine-restricted diet to prevent both liver failure and carcinogenesis. There remains a need in the art for easy to administer, effective treatment(s) to ameliorate the symptoms of these diseases and allow patients to utilize normal diets.

SUMMARY OF THE INVENTION

The present invention provides engineered tyrosine ammonia-lyase (TAL) polypeptides and compositions thereof. In some embodiments, the engineered TAL polypeptides have been optimized to provide enhanced catalytic activity while reducing sensitivity to proteolysis and increasing tolerance to acidic pH levels. The invention also provides methods for utilization of the compositions comprising the engineered TAL polypeptides for therapeutic and industrial purposes.

In some embodiments, the present invention provides engineered TAL polypeptides (also referred to herein as "recombinant TAL polypeptides") and biologically active fragments and analogs thereof having improved properties when compared to a wild-type TAL enzyme and/or a reference TAL polypeptide under essentially the same conditions. The invention is further directed to methods of using the engineered TAL polypeptides and biologically active fragments and analogs thereof in therapeutic and/or industrial compositions.

The present invention provides recombinant tyrosine ammonia lyases and/or biologically active recombinant tyrosine ammonia lyase fragments comprising an amino acid sequence comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the tyrosine ammonia lyase comprises at least one substitution at position or set of positions selected from 79/95/107, 79/107, 79/107/410, 79/410, 95/107/184, 95/107/184/534, 95/184/534, 99/107/184, 107/184/534, and 107/401/534, wherein the positions are numbered with reference to SEQ ID NO: 2. In some embodiments, the tyrosine ammonia lyase comprises at least one substitution or substitution sets at one or more positions selected from 79T/95A/107S, 79T/107S, 79T/107S/410K, 79T/410K, 95A/107A/184S, 95A/107S/184S/534S, 95A/184S/534S, 99H/107A/184S, 107A/184S/534S, and 107S/401P/534S, wherein the positions are numbered with reference to SEQ ID NO: 2. In some embodiments, the tyrosine ammonia lyase comprises at least one substitution or substitution sets at one or more positions selected from S79T/K95A/V107S, S79T/V107S, S79T/V107S/P410K, S79T/P410K, K95A/V107A/Y184S, K95A/V107S/Y184S/A534S, K95A/Y184S/A534S, N99H/V107A/Y184S, V107A/Y184S/A534S, and V107S/A401P/A534S, wherein the positions are numbered with reference to SEQ ID NO: 2.

In some embodiments, the tyrosine ammonia lyase comprises at least one substitution or substitution set at one or more amino acid positions selected from 28, 29, 33, 33/34/37/46/279/554, 33/34/37/90/554, 33/34/46/66/90/289, 33/34/90/289/554, 33/34/279/289, 33/66, 33/66/289, 33/66/289/554, 34/37/46/289, 34/37/66/279/289, 34/46, 34/56/90, 34/56/90/289, 34/66/289, 34/90/289/554, 34/90/519, 36/70/234/302/461/500, 36/79, 36/79/304/407, 36/79/407/461/500/531, 36/111/304/461/531, 36/407/461/500/531, 37, 46, 46/66/289/519/554, 49, 56, 66, 66/90/279/289/554, 66/90/289/554, 69, 70/79/234/361/407, 70/111/461/500/531, 70/304/407/461, 72, 79/111/234/361/500, 79/111/234/531, 79/111/361, 79/111/531, 79/304/361, 79/304/461/531, 79/407/461, 88, 90/289/519, 90/289/554, 131, 142, 198, 201, 272, 278, 279/289/554, 289/519/554, 289/554, 295, 304/361, 305, 350, 361/500/531, 461/500, 490, 491, 499, 510, 518, 519, 521, 522, 523, 524, 531, 540, 541, 544, 547, 548, 554, 557, 558, and 560, wherein the positions are numbered with reference to SEQ ID NO: 14. In some embodiments, the tyrosine ammonia lyase comprises at least one substitution or substitution sets selected from 28A, 28C, 28G, 28N, 28T, 29A, 29E, 29G, 29R, 29W, 33D/34E/37S/46R/279S/554Q, 33D/34E/37S/90S/554Q, 33D/34E/46R/66N/90S/289R, 33D/34E/90S/289R/554Q, 33D/34E/279S/289R, 33D/66N, 33D/66N/289R, 33D/66N/289R/554Q, 33N, 34E/37R/46R/289R, 34E/37S/66N/279S/289R, 34E/46R, 34E/56G/905, 34E/56G/90S/289R, 34E/66N/289R, 34E/90S/289R/554Q, 34E/90S/519P, 36V/70K/234H/302M/461M/500T, 36V/79T, 36V/79T/304G/407V, 36V/79T/407V/461M/500T/531D, 36V/111K/304G/461M/531D, 36V/407V/461M/500T/531D, 37A, 37D, 46R, 46R/66N/289R/519P/554Q, 46T, 49D, 49N, 56G, 56R, 66N/90S/279D/289R/554Q, 66N/90S/289R/554Q, 66R, 66S, 69S, 70K/79T/234H/361M/407V, 70K/111K/461M/500T/531D, 70K/304G/407V/461M, 72T, 79T/111K/234H/361M/500T, 79T/111K/234H/531D, 79T/111K/361M, 79T/111K/531D, 79T/304G/361M, 79T/304G/461M/531D, 79T/407V/461M, 88E, 88Q, 90S/289R/519P, 90S/289R/554Q, 131G, 131M, 131S, 131W, 142R, 198R, 201R, 272S, 278S, 279S/289R/554Q, 289R/519P/554Q, 289R/554Q, 295Q, 304G/361M, 305H, 350G, 361M/500Q/531D, 461M/500T, 490A, 490I, 490S, 490V, 491L, 491V, 499T, 510K, 518E, 518V, 519D, 519E, 519L, 519P, 519Q, 521D, 522G, 522K, 522R, 522V, 522Y, 523A, 523D, 523H, 523I, 523S, 524A, 524I, 524L, 524Q, 524T, 524Y, 531D, 540E, 540R, 541A, 544E, 544G, 544R, 544S, 547A, 547C, 547G, 547K, 547Q, 547R, 547S, 548A, 548G, 548K, 548Q, 548R, 548T, 554E, 554R, 554S, 554Y, 557E, 557R, 558A, 558D, 558H, 558S, 560G, 560M, 560R, and 560T, wherein the positions are numbered with reference to SEQ ID NO: 14. In some embodiments, the tyrosine ammonia lyase comprises at least one substitution or substitution sets selected from K28A, K28C, K28G, K28N, K28T, P29A, P29E, P29G, P29R, P29W, K33D/K34E/Q37S/L46R/Q279S/K554Q, K33D/K34E/Q37S/T90S/K554Q, K33D/K34E/L46R/Q66N/T90S/A289R, K33D/K34E/T90S/A289R/K554Q, K33D/K34E/Q279S/A289R, K33D/Q66N, K33D/Q66N/A289R, K33D/Q66N/A289R/K554Q, K33N, K34E/Q37R/L46R/A289R, K34E/Q37S/Q66N/Q279S/A289R, K34E/L46R, K34E/K56G/T90S, K34E/K56G/T90S/A289R, K34E/Q66N/A289R, K34E/T90S/A289R/K554Q, K34E/T90S/A519P, A36V/S70K/Y234H/R302M/L461M/C500T, A36V/S79T, A36V/S79T/E304G/S407V, A36V/S79T/S407V/L461M/C500T/N531D, A36V/Q111K/E304G/L461M/N531D, A36V/S407V/L461M/C500T/N531D, Q37A, Q37D, L46R, L46R/Q66N/A289R/A519P/K554Q, L46T, T49D, T49N, K56G, K56R, Q66N/T90S/Q279D/A289R/K554Q, Q66N/T90S/A289R/K554Q, Q66R, Q66S, A69S, S70K/S79T/Y234H/L361M/S407V, S70K/Q111K/L461M/C500T/N531D, S70K/E304G/S407V/L461M, E72T, S79T/Q111K/Y234H/L361M/C500T, S79T/Q111K/Y234H/N531D, S79T/Q111K/L361M, S79T/Q111K/N531D, S79T/E304G/L361M, S79T/E304G/L461M/N531D, S79T/S407V/L461M, V88E, V88Q, T90S/A289R/A519P, T90S/A289R/K554Q, H131G, H131M, H131S, H131W, Q142R, E198R, K201R, P272S, A278S, Q279S/A289R/K554Q, A289R/ A519P/K554Q, A289R/K554Q, L295Q, E304G/L361M, Q305H, A350G, L361M/C500Q/N531D, L461M/C500T, K490A, K490I, K490S, K490V, I491L, I491V, Q499T, L510K, L518E, L518V, A519D, A519E, A519L, A519P, A519Q, S521D, E522G, E522K, E522R, E522V, E522Y, E523A, E523D, E523H, E523I, E523S, R524A, R524I, R524L, R524Q, R524T, R524Y, N531D, A540E, A540R, L541A, A544E, A544G, A544R, A544S, T547A, T547C, T547G, T547K, T547Q, T547R, T547S, S548A, S548G, S548K, S548Q, S548R, S548T, K554E, K554R, K554S, K554Y, N557E, N557R, Q558A, Q558D, Q558H, Q558S, V560G, V560M, V560R, and V560T, wherein the positions are numbered with reference to SEQ ID NO: 14.

In some embodiments, the tyrosine ammonia lyase comprises at least one substitution or substitution set at one or more amino acid positions selected from 28/34/49/70/234/ 289/544/554, 33/34/49/234/531/547/554, 33/34/66/70/519/ 531, 33/34/66/289/522/531, 33/34/70/234/289/519, 33/34/ 70/234/518/519/547/554, 33/34/70/289/522/554, 33/34/ 289/522/531, 34/49/66/531, 34/49/234/531/554, 34/49/289/ 544/547, 34/66/70/234/518/519/547, 34/66/531/554, 34/66/ 554, 34/70/234/289/522, 34/70/234/554, 34/70/289/522, 34/234/522/554, 34/289, 34/289/522/531, 34/289/522/544/ 554, 34/522, 34/544, 66/70/234, and 234/531/544/547, wherein the positions are numbered with reference to SEQ ID NO: 86. In some embodiments, the tyrosine ammonia lyase comprises at least one substitution or substitution sets selected from 28/34/49/70/234/289/544/554, 33/34/49/234/ 531/547/554, 33/34/66/70/519/531, 33/34/66/289/522/531, 33/34/70/234/289/519, 33/34/70/234/518/519/547/554, 33/34/70/289/522/554, 33/34/289/522/531, 34/49/66/531, 34/49/234/531/554, 34/49/289/544/547, 34/66/70/234/518/ 519/547, 34/66/531/554, 34/66/554, 34/70/234/289/522, 34/70/234/554, 34/70/289/522, 34/234/522/554, 34/289, 34/289/522/531, 34/289/522/544/554, 34/522, 34/544, 66/70/234, and 234/531/544/547, wherein the positions are numbered with reference to SEQ ID NO: 86. In some embodiments, the tyrosine ammonia lyase comprises at least one substitution or substitution sets selected from 28N/34E/ 49N/70S/234Y/289R/544E/554Q, 33D/34E/66N/70S/519P/ 531D, 33D/34E/66N/289R/522K/531D, 33D/34E/70S/ 234Y/289R/519P, 33D/34E/70S/234Y/518V/519P/547Q/ 554Q, 33D/34E/70S/289R/522K/554Q, 33D/34E/289R/ 522K/531D, 33N/34E/49N/234Y/531D/547Q/554Q, 34E/ 49N/66N/531D, 34E/49N/234Y/531D/554Q, 34E/49N/ 289R/544E/547Q, 34E/66N/70S/234Y/518V/519P/547Q, 34E/66N/531D/554Q, 34E/66N/554Q, 34E/70S/234Y/ 289R/522K, 34E/70S/234Y/554Q, 34E/70S/289R/522K, 34E/234Y/522K/554Q, 34E/289R, 34E/289R/522K/531D, 34E/289R/522K/544E/554Q, 34E/522K, 34E/544E, 66N/ 70S/234Y, and 234Y/531D/544E/547Q, wherein the positions are numbered with reference to SEQ ID NO: 86.

In some embodiments, the tyrosine ammonia lyase comprises at least one substitution or substitution set at one or more amino acid positions selected from 31, 37/49/56/66/ 111, 37/49/56/234/557, 37/49/56/500/524, 37/49/66/111/ 234, 37/49/111/524, 37/111, 37/111/361/500/557/558, 37/234, 43/59/93/506, 43/306, 43/306/506, 49/56/66/111/ 153/234/500/524, 49/66, 56/111/234, 56/234/500, 61, 65, 65/336, 66, 66/111/234/500, 93/506, 95, 103, 103/107/417/ 421, 103/306/506, 103/421, 104/105, 107, 107/417/421, 111/234/548/558, 111/361, 145, 146, 155, 172, 197, 211, 234, 234/524, 237/238/506, 286, 304, 306, 306/506, 328, 336, 361/524/557/558, 407, 417/421, 421, 471, 504, 506, 549, and 558, wherein the positions are numbered with reference to SEQ ID NO: 334. In some embodiments, the tyrosine ammonia lyase comprises at least one substitution or substitution sets selected from 31S, 37D/49N/56G/66N/ 111K, 37D/49N/56G/234Y/557E, 37D/49N/56G/500T/ 524Q, 37D/49N/66N/111K/234Y, 37D/49N/111K/524Q, 37D/111K, 37D/111K/361L/500T/557E/558D, 37D/234Y, 43T/59A/93Q/506R, 43T/306L, 43T/306L/506R, 49N/56G/ 66N/111K/153N/234Y/500T/524Q, 49N/66N, 56G/111K/ 234Y, 56G/234Y/500T, 61V, 65M, 65N/336V, 66N, 66N/ 111K/234Y/500T, 93Q/506R, 95K, 95V, 103L, 103W, 103W/107T/417A/421S, 103W/306L/506R, 103W/421S, 104F/105M, 107T, 107T/417A/421A, 111K/234Y/548K/ 558D, 111K/361L, 145V, 146K, 155L, 155S, 172S, 197T, 211K, 234Y, 234Y/524Q, 237R/238V/506R, 286Q, 286R, 304N, 306L, 306L/506R, 328A, 336V, 361L/524Q/557E/ 558D, 407K, 407T, 417A/421S, 421S, 471Y, 504R, 506R, 506V, 549D, and 558D, wherein the positions are numbered with reference to SEQ ID NO: 334. In some embodiments, the tyrosine ammonia lyase comprises at least one substitution or substitution sets selected from T31S, Q37D/T49N/ K56G/Q66N/Q111K, Q37D/T49N/K56G/H234Y/N557E, Q37D/T49N/K56G/C500T/R524Q, Q37D/T49N/Q66N/ Q111K/H234Y, Q37D/T49N/Q111K/R524Q, Q37D/ Q111K, Q37D/Q111K/M361L/C500T/N557E/Q558D, Q37D/H234Y, A43T/S59A/L93Q/L506R, A43T/P306L, A43T/P306L/L506R, T49N/K56G/Q66N/Q111K/T153N/ H234Y/C500T/R524Q, T49N/Q66N, K56G/Q111K/ H234Y, K56G/H234Y/C500T, C61V, A65M, A65N/I336V, Q66N, Q66N/Q111K/H234Y/C500T, L93Q/L506R, A95K, A95V, R103L, R103W, R103W/A107T/G417A/T421S, R103W/P306L/L506R, R103W/T421S, Y104F/H105M, A107T, A107T/G417A/T421A, Q111K/H234Y/S548K/ Q558D, Q111K/M361L, E145V, T146K, H155L, H155S, A172S, P197T, L211K, H234Y, H234Y/R524Q, Q237R/ N238V/L506R, A286Q, A286R, E304N, P306L, P306L/ L506R, S328A, I336V, M361L/R524Q/N557E/Q558D, V407K, V407T, G417A/T421S, T421S, Q471Y, A504R, L506R, L506V, G549D, and Q558D, wherein the positions are numbered with reference to SEQ ID NO: 334.

In some embodiments, the tyrosine ammonia lyase comprises at least one substitution or substitution set at one or more amino acid positions selected from 31/61/95/286/328, 31/61/95/407/504, 31/61/95/471/504, 31/61/407/504, 31/95/ 155/286/504/549, 31/95/237/504/547/549, 31/95/286/504, 31/95/286/504/549, 31/95/328/504, 31/95/504, 31/95/549, 37/49/56/59/145, 37/103/111/145/421/500/524, 49/56/59/ 234/500, 49/59/66/111/145/234, 49/59/145/234/421, 56/59/ 66/234, 56/59/111/145, 56/59/111/145/234/421, 56/66/145/ 500, 56/103/111/145/234/500, 59/103/145/234/421/500, 59/103/234/421, 59/145, 59/234, 61, 61/95/155/286/407/ 471, 61/95/155/407, 61/95/286, 61/95/286/328/504, 61/95/ 328/407, 61/95/328/549, 61/95/407, 61/95/504/547, 61/286/ 407, 61/328, 61/328/504, 61/328/504/549, 61/407, 61/504, 66/103/145/234/421, 95/155/286/328/407/504, 95/155/286/ 549, 95/286, 95/286/328/407/504, 95/286/328/504, 95/286/ 547, 95/287/504/549, 95/328/504, 95/407, 95/407/504, 95/504/547, 95/549, 103/111/145/234/421, 111/145/234, 111/234, 145/234/500, 286/328/407/504/549, and 549, wherein the positions are numbered with reference to SEQ ID NO: 388. In some embodiments, the tyrosine ammonia lyase comprises at least one substitution or substitution sets selected from 31S/61V/95K/286Q/328A, 31S/61V/95K/ 407T/504R, 31S/61V/95K/471Y/504R, 31S/61V/407T/ 504R, 31S/95K/155S/286Q/504R/549D, 31S/95K/237Y/ 504R/547Q/549D, 31S/95K/286Q/504R, 31S/95K/286Q/ 504R/549D, 31S/95K/328A/504R, 31S/95K/504R, 31S/ 95K/549D, 37D/49N/56G/59A/145V, 37D/103L/111K/ 145V/421S/500T/524Q, 49N/56G/59A/234Y/500T, 49N/

59A/66N/111K/145V/234Y, 49N/59A/145V/234Y/421S, 56G/59A/66N/234Y, 56G/59A/111K/145V, 56G/59A/111K/145V/234Y/421S, 56G/66N/145V/500T, 56G/103L/111K/145V/234Y/500T, 59A/103L/145V/234Y/421S/500T, 59A/103L/234Y/421S, 59A/145V, 59A/234Y, 61V, 61V/95K/155S/286Q/407T/471Y, 61V/95K/155S/407T, 61V/95K/286Q, 61V/95K/286Q/328A/504R, 61V/95K/328A/407T, 61V/95K/328A/549D, 61V/95K/407T, 61V/95K/504R/547Q, 61V/286Q/407T, 61V/328A, 61V/328A/504R, 61V/328A/504R/549D, 61V/407T, 61V/504R, 66N/103L/145V/234Y/421S, 95K/155S/286Q/328A/407T/504R, 95K/155S/286Q/549D, 95K/286Q, 95K/286Q/328A/407T/504R, 95K/286Q/328A/504R, 95K/286Q/547Q, 95K/287S/504R/549D, 95K/328A/504R, 95K/407T, 95K/407T/504R, 95K/504R/547Q, 95K/549D, 103L/111K/145V/234Y/421S, 111K/145V/234Y, 111K/234Y, 145V/234Y/500T, 286Q/328A/407T/504R/549D, and 549D, wherein the positions are numbered with reference to SEQ ID NO: 388. In some embodiments, the tyrosine ammonia lyase comprises at least one substitution or substitution sets selected from T31S/C61V/A95K/A286Q/S328A, T31S/C61V/A95K/V407T/A504R, T31S/C61V/A95K/Q471Y/A504R, T31S/C61V/V407T/A504R, T31S/A95K/H155S/A286Q/A504R/G549D, T315/A95K/Q237K/A504R/T547Q/G549D, T31S/A95K/A286Q/A504R, T31S/A95K/A286Q/A504R/G549D, T31S/A95K/S328A/A504R, T31S/A95K/A504R, T315/A95K/G549D, Q37D/T49N/K56G/559A/E145V, Q37D/R103L/Q111K/E145V/T421S/C500T/R524Q, T49N/K56G/559A/H234Y/C500T, T49N/559A/Q66N/Q111K/E145V/H234Y, T49N/559A/E145V/H234Y/T421S, K56G/559A/Q66N/H234Y, K56G/559A/Q111K/E145V, K56G/559A/Q111K/E145V/H234Y/T421S, K56G/Q66N/E145V/C500T, K56G/R103L/Q111K/E145V/H234Y/C500T, 559A/R103L/E145V/H234Y/T421S/C500T, 559A/R103L/H234Y/T421S, 559A/E145V, 559A/H234Y, C61V, C61V/A95K/H155S/A286Q/V407T/Q471Y, C61V/A95K/H155S/V407T, C61V/A95K/A286Q, C61V/A95K/A286Q/S328A/A504R, C61V/A95K/S328A/V407T, C61V/A95K/S328A/G549D, C61V/A95K/V407T, C61V/A95K/A504R/T547Q, C61V/A286Q/V407T, C61V/S328A, C61V/S328A/A504R, C61V/S328A/A504R/G549D, C61V/V407T, C61V/A504R, Q66N/R103L/E145V/H234Y/T421S, A95K/H155S/A286Q/S328A/V407T/A504R, A95K/H155S/A286Q/S328A/V407T/A504R, A95K/H155S/A286Q/S328A/V407T/A504R, A95K/A286Q, A95K/A286Q/S328A/V407T/A504R, A95K/A286Q/S328A/A504R, A95K/A286Q/T547Q, A95K/G287S/A504R/G549D, A95K/S328A/A504R, A95K/V407T, A95K/V407T/A504R, A95K/A504R/T547Q, A95K/G549D, R103L/Q111K/E145V/H234Y/T421S, Q111K/E145V/H234Y, Q111K/H234Y, E145V/H234Y/C500T, A286Q/S328A/V407T/A504R/G549D, and G549D, wherein the positions are numbered with reference to SEQ ID NO: 388.

In some embodiments, the tyrosine ammonia lyase comprises at least one substitution or substitution set at one or more amino acid positions selected from 14/56/114, 14/114/283/289, 14/114/283/289/291, 14/114/283/289/562, 14/114/291/518/562, 14/114/518, 14/234/283/291/305, 14/283/289/562, 29/66/111, 29/66/111/540, 29/111, 29/111/523, 33/46/49, 33/46/49/336/519/548/549, 33/46/49/549, 33/46/518/534/548/549, 33/46/519, 33/49/336, 33/336/519, 36/37/56/59/145/234/328, 36/37/59/131/531, 36/37/103/234, 36/37/131/145/234/328, 36/37/145/234, 36/37/145/234/328/471/531, 36/37/234/328/531, 36/56/145/234/328, 36/59/234/328, 36/59/531, 36/103/145/328/531, 36/131, 36/234/531, 37/56/59/103/145/234/328/471/531, 37/56/59/234/328/524/531, 37/56/59/234/531, 37/56/234/531, 37/59/234, 37/234/471, 46/49, 46/49/518/519/548/549, 46/49/519, 46/155, 46/548, 49/519, 56, 56/59/103/471/531, 56/59/471/531, 56/114/206/283, 56/114/291, 56/114/291/518/562, 56/114/518, 56/518, 59/328/524/531, 66/540, 111, 111/510/521/523/541/558, 111/523/557, 114, 114/206/283/289/562, 114/283/289/291, 114/283/289/305/518, 114/283/291, 114/289, 114/289/562, 114/291, 114/291/518, 114/518/562, 114/562, 131/234/328, 234, 234/328, 234/328/471, 234/531, 289/562, 305, 336/519, 518/519/548/549, 519, 521, 523, 531, 541, 548/549, and 549, wherein the positions are numbered with reference to SEQ ID NO: 604. In some embodiments, the tyrosine ammonia lyase comprises at least one substitution or substitution sets selected from 14S/56R/114P, 14S/114P/283D/289Q, 14S/114P/283D/289Q/291V, 14S/114P/283S/289Q/562S, 14S/114P/291V/518Q/562S, 14S/114P/518Q, 14S/234L/283D/291V/305E, 14S/283D/289Q/562S, 29E/66N/111K/540R, 29E/111K, 29E/111K/523D, 29G/66N/111K, 33N/46R/49D/549D, 33N/46T/49D, 33N/46T/49D/336V/519E/548K/549D, 33N/46T/49D/549D, 33N/46T/518V/534S/548K/549D, 33N/46T/519E, 33N/49D/336V, 33N/336V/519P, 36V/37A/56G/59A/145V/234Y/328S, 36V/37A/59A/131M/531D, 36V/37A/103L/234Y, 36V/37A/131M/145V/234Y/328S, 36V/37A/145V/234Y, 36V/37A/145V/234Y/328S/471Y/531D, 36V/37A/234Y/328Q/531D, 36V/56G/145V/234Y/328S, 36V/59A/234Y/328S, 36V/59A/531D, 36V/103L/145V/328S/531D, 36V/131M, 36V/234Y/531D, 37A/56G/59A/103L/145V/234Y/328Q/471Y/531D, 37A/56G/59A/234Y/328S/524L/531D, 37A/56G/59A/234Y/531D, 37A/56G/234Y/531D, 37A/59A/234Y, 37A/234Y/471Y, 46R/49D, 46R/49D/518V/519E/548K/549D, 46R/49D/519P, 46R/155L, 46T/49D/519E, 46T/548K, 49D/519P, 56G/59A/103L/471Y/531D, 56G/59A/471Y/531D, 56R, 56R/114P/206P/283D, 56R/114P/291V, 56R/114P/291V/518Q/562S, 56R/114P/518Q, 56R/518Q, 59A/328Q/524L/531D, 66R/540R, 111K, 111K/510K/521D/523A/541A/558D, 111K/523A/557E, 114P, 114P/206P/283S/289Q/562S, 114P/283D/289Q/291V, 114P/283D/289Q/305E/518Q, 114P/283D/291V, 114P/289Q, 114P/289Q/562S, 114P/291V, 114P/291V/518Q, 114P/518Q/562S, 114P/562S, 131M/234Y/328Q, 234Y, 234Y/328Q, 234Y/328S/471Y, 234Y/531D, 289Q/562S, 305E, 336V/519P, 518V/519E/548K/549D, 519P, 521D, wherein the positions are numbered with reference to SEQ ID NO: 604. In some embodiments, the tyrosine ammonia lyase comprises at least one substitution or substitution sets selected from F14S/K56R/S114P, F14S/S114P/E283D/R289Q, F14S/S114P/E283D/R289Q/I291V, F14S/S114P/E283S/R289Q/I562S, F14S/S114P/I291V/K518Q/I562S, F14S/S114P/K518Q, F14S/H234L/E283D/I291V/Q305E, F14S/E283D/R289Q/I562S, P29E/Q66N/Q111K/A540R, P29E/Q111K, P29E/Q111K/E523D, P29G/Q66N/Q111K, K33N/L46R/T49D/G549D, K33N/L46T/T49D, K33N/L46T/T49D/I336V/A519E/S548K/G549D, K33N/L46T/T49D/G549D, K33N/L46T/K518V/A534S/S548K/G549D, K33N/L46T/A519E, K33N/T49D/I336V, K33N/I336V/A519P, A36V/Q37A/K56G/S59A/E145V/H234Y/A328S, A36V/Q37A/S59A/H131M/N531D, A36V/Q37A/R103L/H234Y, A36V/Q37A/H131M/E145V/H234Y/A328S, A36V/Q37A/E145V/H234Y, A36V/Q37A/E145V/H234Y/A328S/Q471Y/N531D, A36V/Q37A/H234Y/A328Q/N531D, A36V/K56G/E145V/H234Y/A328S, A36V/S59A/H234Y/A328S, A36V/S59A/N531D, A36V/R103L/E145V/A328S/N531D, A36V/H131M, A36V/H234Y/N531D, Q37A/K56G/S59A/R103L/E145V/H234Y/A328Q/Q471Y/N531D, Q37A/K56G/S59A/H234Y/A328S/R524L/N531D, Q37A/K56G/S59A/H234Y/N531D, Q37A/K56G/H234Y/N531D, Q37A/S59A/H234Y, Q37A/H234Y/Q471Y, L46R/T49D, L46R/

T49D/A519P, L46R/H155L, L46T/T49D/A519E, L46T/ S548K, T49D/A519P, K56G/S59A/R103L/Q471Y/N531D, K56G/S59A/Q471Y/N531D, K56R, K56R/S114P/E206P/ E283D, K56R/S114P/I291V, K56R/S114P/I291V/K518Q/ I562S, K56R/S114P/K518Q, K56R/K518Q, S59A/A328Q/ R524L/N531D, Q66R/A540R, Q111K, Q111K/L510K/ S521D/E523A/L541A/Q558D, Q111K/E523A/N557E, S114P, S114P/E206P/E283S/R289Q/I562S, S114P/E283D/ R289Q/I291V, S114P/E283D/R289Q/Q305E/K518Q, S114P/E283D/I291V, S114P/R289Q, S114P/R289Q/I562S, S114P/I291V, S114P/I291V/K518Q, S114P/K518Q/I562S, S114P/I562S, H131M/H234Y/A328Q, H234Y, H234Y/ A328Q, H234Y/A328S/Q471Y, H234Y/N531D, R289Q/ I562S, Q305E, I336V/A519P, K518V/A519E/S548K/ G549D, A519P, S521D, E523D, N531D, L541A, S548K/ G549D, and G549D, wherein the positions are numbered with reference to SEQ ID NO: 604.

In some embodiments, the tyrosine ammonia lyase comprises at least one substitution or substitution set at one or more amino acid positions selected from 20/49/56/59/111/ 291, 20/59/234/518/549/562, 49/56/59/66/291/531/549, 49/56/59/111/549, 49/56/66/111/234/291/518, 49/56/66/ 234, 49/59/66/145/234, 49/59/66/289, 49/59/289/562, 49/66/111/234/291/518/562, 49/111/531, 49/234, 56/59/111/ 234/289, 56/59/111/234/531, 56/59/111/283/518/531, 56/59/111/291, 56/59/111/291/518/531, 56/59/145/289/518/ 562, 56/59/234, 56/59/234/518, 56/59/518, 56/111/145/234/ 289/531/562, 56/111/145/234/518/549/562, 56/111/518/ 549, 56/234/291, 59, 59/111, 59/145/234/291, 59/234/291, 59/234/291/387/549/562, 111/145, 111/145/234/291/562, 111/145/234/562, 111/234, 111/289, 111/291, 111/518, 234, 234/518/549, 291/518/549, 518, 518/531/549/562, 531, and 549, wherein the positions are numbered with reference to SEQ ID NO: 736. In some embodiments, the tyrosine ammonia lyase comprises at least one substitution or substitution sets selected from 20G/49D/56G/59A/111K/291V, 20G/59A/234Y/518Q/549D/562S, 49D/56G/59A/66N/ 291V/531D/549D, 49D/56G/59A/111K/549D, 49D/56G/ 66N/111K/234Y/291V/518Q, 49D/56G/66N/234Y, 49D/ 59A/66N/145V/234Y, 49D/59A/66N/289Q, 49D/59A/ 289Q/562S, 49D/66N/111K/234Y/291V/518Q/562S, 49D/ 111K/531D, 49D/234Y, 56G/59A/111K/234Y/289Q, 56G/ 59A/111K/234Y/531D, 56G/59A/111K/283D/518Q/531D, 56G/59A/111K/291V, 56G/59A/111K/291V/518Q/531D, 56G/59A/145V/289Q/518Q/562S, 56G/59A/234Y, 56G/ 59A/234Y/518Q, 56G/59A/518Q, 56G/111K/145V/234Y/ 289Q/531D/562S, 56G/111K/145V/234Y/518Q/549D/ 562S, 56G/111K/518Q/549D, 56G/234Y/291V, 59A, 59A/ 111K, 59A/145V/234Y/291V, 59A/234Y/291V, 59A/234Y/ 291V/387T/549D/562S, 111K/145V, 111K/145V/234Y/ 291V/562S, 111K/145V/234Y/562S, 111K/234Y, 111K/ 289Q, 111K/291V, 111K/518Q, 234Y, 234Y/518Q/549D, 291V/518Q/549D, 518Q, 518Q/531D/549D/562S, 531D, and 549D, wherein the positions are numbered with reference to SEQ ID NO: 736. In some embodiments, the tyrosine ammonia lyase comprises at least one substitution or substitution sets selected from D20G/T49D/R56G/S59A/ Q111K/I291V, D20G/S59A/H234Y/K518Q/G549D/I562S, T49D/R56G/S59A/Q66N/I291V/N531D/G549D, T49D/ R56G/S59A/Q111K/G549D, T49D/R56G/Q66N/Q111K/ H234Y/I291V/K518Q, T49D/R56G/Q66N/H234Y, T49D/ S59A/Q66N/E145V/H234Y, T49D/S59A/Q66N/R289Q, T49D/S59A/R289Q/I562S, T49D/Q66N/Q111K/H234Y/ I291V/K518Q/I562S, T49D/Q111K/N531D, T49D/H234Y, R56G/S59A/Q111K/H234Y/R289Q, R56G/S59A/Q111K/ H234Y/N531D, R56G/S59A/Q111K/E283D/K518Q/ N531D, R56G/S59A/Q111K/I291V, R56G/S59A/Q111K/ I291V/K518Q/N531D, R56G/S59A/E145V/R289Q/ K518Q/I562S, R56G/S59A/H234Y, R56G/S59A/H234Y/ K518Q, R56G/S59A/K518Q, R56G/Q111K/E145V/ H234Y/R289Q/N531D/I562S, R56G/Q111K/E145V/ H234Y/K518Q/G549D/I562S, R56G/Q111K/K518Q/ G549D, R56G/H234Y/I291V, S59A, S59A/Q111K, S59A/ E145V/H234Y/I291V, S59A/H234Y/I291V, S59A/H234Y/ I291V/I387T/G549D/I562S, Q111K/E145V, Q111K/ E145V/H234Y/I291V/I562S, Q111K/E145V/H234Y/ I562S, Q111K/H234Y, Q111K/R289Q, Q111K/I291V, Q111K/K518Q, H234Y, H234Y/K518Q/G549D, I291V/ K518Q/G549D, K518Q, K518Q/N531D/G549D/I562S, N531D, and G549D, wherein the positions are numbered with reference to SEQ ID NO: 736.

In some embodiments, the tyrosine ammonia lyase comprises at least one substitution or substitution set at one or more amino acid positions selected from 33/37, 33/37/46/ 305, 33/37/103, 33/37/103/305, 33/37/103/305/336/541/ 548, 33/37/103/305/523/548, 33/37/103/305/548, 33/37/ 103/336/518/541/548, 33/37/103/471/519/548, 33/37/103/ 518/523/541, 33/37/103/519/523, 33/37/103/523, 33/37/ 103/540, 33/37/305, 33/37/305/328, 33/37/305/328/548, 33/37/305/336/471/541, 33/37/305/336/518/523, 33/37/ 305/336/521/523/548, 33/37/305/336/521/548, 33/37/305/ 336/541, 33/37/305/471/521/548, 33/37/305/521/540, 33/37/305/540, 33/37/305/541, 33/37/336, 33/37/336/540, 33/37/336/540/548, 33/37/471/523/540/548, 33/37/518/ 521/540, 33/37/518/521/548, 33/37/518/548, 33/37/521/ 548, 33/37/523, 33/37/523/540/548, 33/37/540, 33/37/548, 33/46, 33/46/66/305/521/523/540/548, 33/46/103/305/336/ 518/519/540, 33/46/103/305/336/548, 33/46/103/305/540, 33/46/103/540/548, 33/46/305, 33/46/305/336, 33/46/305/ 518/540/548, 33/46/336/471/519/523/548, 33/46/336/521, 33/46/336/521/523, 33/46/336/540, 33/46/336/540/548, 33/46/518/521/548, 33/46/521/548, 33/46/523, 33/46/541, 33/46/548, 33/103/336/518/521/548, 33/471/523/541, 37, 37/103, 37/103/305/336, 37/103/305/336/521/523/540/548, 37/103/305/336/523/540, 37/103/305/471, 37/103/305/471/ 540/548, 37/103/305/521/541/548, 37/103/305/540, 37/103/ 328/336/518/523/548, 37/103/328/521/541/548, 37/103/ 336, 37/103/336/521/541, 37/103/519/541/548, 37/103/540, 37/103/541/548, 37/305, 37/305/336, 37/305/336/521/540/ 548, 37/305/336/523/548, 37/305/336/540/548, 37/305/336/ 541/548, 37/305/471, 37/305/471/523/540/548, 37/305/471/ 540/548, 37/305/519/548, 37/305/521/523/540/548, 37/305/ 521/540, 37/305/521/541/548, 37/305/523/541/548, 37/305/ 541, 37/305/541/548, 37/305/548, 37/336, 37/336/471/541/ 548, 37/336/521/523, 37/336/521/523/548, 37/336/523/548, 37/336/540, 37/336/548, 37/471, 37/471/518, 37/471/518/ 519/523, 37/471/521/540/548, 37/519, 37/521/523/548, 37/521/540, 37/523/541, 37/523/548, 37/540, 37/540/548, 37/541, 37/548, 46, 46/49/59/111/523/531/549, 46/49/111/ 234/289/436/549, 46/49/111/234/289/531/549, 46/49/111/ 234/336, 46/49/111/234/336/523/549, 46/49/111/336/549, 46/49/234/289/336, 46/49/234/336/521/523/549, 46/49/ 234/540/549, 46/49/234/549, 46/49/289/523/531/549/562, 46/49/531/549, 46/59/234, 46/59/549/562, 46/103/305, 46/103/305/336/471/540/548, 46/103/305/336/523, 46/103/ 305/471/540/548, 46/103/305/520/540, 46/103/305/548, 46/103/523/548, 46/103/540/548, 46/103/541, 46/103/541/ 548, 46/103/548, 46/111/234/289/531/549, 46/111/234/521/ 549, 46/111/523/531/549, 46/234/289/549, 46/234/521/523/ 531/540/549, 46/234/549, 46/289/549, 46/305, 46/305/336, 46/305/336/518, 46/305/336/522, 46/305/336/548, 46/305/ 471, 46/305/523/548, 46/305/548, 46/336/521/523, 46/336/ 523/548, 46/336/540, 46/336/540/548, 46/521/523, 46/521/ 523/540, 46/521/523/549, 46/521/548, 46/523/540, 46/523/

541/548, 46/541, 46/541/548, 46/548, 46/549, 49, 49/59/111/234/289/521, 49/59/111/289/523, 49/59/234/289/336, 49/59/234/289/523/531/549, 49/59/289/305/336, 49/59/289/336, 49/59/336, 49/59/521/531, 49/111, 49/111/234, 49/111/234/289/336/523/531/549, 49/111/234/289/521/523/531/549/562, 49/111/234/289/523/549, 49/111/234/336/521/523, 49/111/234/336/523/531, 49/111/234/523/531/549, 49/111/234/531, 49/111/234/549, 49/111/289, 49/111/289/336/521/549, 49/111/523/531/549, 49/111/531/549, 49/234, 49/234/289, 49/234/289/336/531/549, 49/234/289/523, 49/234/289/523/531/540, 49/234/289/523/549, 49/234/305/549, 49/234/521, 49/234/549, 49/289/305/336/523, 49/289/336, 49/289/336/521/531, 49/336/521/562, 49/521/531/549/562, 49/521/549, 49/523/549, 49/549, 59, 59/111/234/289/305/336/549, 59/111/234/289/305/549, 59/111/289, 59/111/336, 59/549, 103, 103/336/519/548, 103/521/523/540, 111/234/289, 111/234/289/523, 111/289/336/521, 111/289/336/523/549, 111/336/562, 111/521/523/549, 234, 234/289, 234/289/336/523, 234/289/523/531/549/562, 234/289/523/549, 234/289/531, 234/289/549, 234/336, 234/336/531/562, 234/521/523, 234/521/523/549, 234/523/531, 234/531/549, 234/540, 234/549, 234/562, 289, 289/336/549, 289/521/523, 289/521/523/540, 289/521/523/549, 289/523, 305/336/541/548, 336/548, 519/548, 521, 521/548, 521/549, 521/562, 523, 531/549, 540, and 549, wherein the positions are numbered with reference to SEQ ID NO: 736. In some embodiments, the tyrosine ammonia lyase comprises at least one substitution or substitution sets selected from 33N/37A, 33N/37A/46R/305E, 33N/37A/103L, 33N/37A/103L/305E, 33N/37A/103L/305E/336V/541A/548K, 33N/37A/103L/305E/523D/548K, 33N/37A/103L/305E/548K, 33N/37A/103L/336V/518V/541A/548K, 33N/37A/103L/471Y/519P/548K, 33N/37A/103L/518V/523D/541A, 33N/37A/103L/519P/523D, 33N/37A/103L/523D, 33N/37A/103L/540R, 33N/37A/305E, 33N/37A/305E/328Q, 33N/37A/305E/328Q/548K, 33N/37A/305E/336V/471Y/541A, 33N/37A/305E/336V/518V/523D, 33N/37A/305E/336V/521D/523D/548K, 33N/37A/305E/336V/521D/548K, 33N/37A/305E/336V/541A, 33N/37A/305E/471Y/521D/548K, 33N/37A/305E/523D/540R, 33N/37A/305E/540R, 33N/37A/305E/541A, 33N/37A/336V, 33N/37A/336V/540R, 33N/37A/336V/540R/548K, 33N/37A/471Y/523D/540R/548K, 33N/37A/518V/521D/540R, 33N/37A/518V/521D/548K, 33N/37A/518V/548K, 33N/37A/521D/548K, 33N/37A/523D, 33N/37A/523D/540R/548K, 33N/37A/540R, 33N/37A/548K, 33N/46R, 33N/46R/66K/305E/521D/523D/540R/548K, 33N/46R/103L/305E/336V/518V/519P/540R, 33N/46R/103L/305E/336V/548K, 33N/46R/103L/305E/540R, 33N/46R/103L/540R/548K, 33N/46R/305E, 33N/46R/305E/336V, 33N/46R/305E/518V/540R/548K, 33N/46R/336V/471Y/519P/523D/548K, 33N/46R/336V/521D, 33N/46R/336V/521D/523D, 33N/46R/336V/540R, 33N/46R/336V/540R/548K, 33N/46R/518V/521D/548K, 33N/46R/521D/548K, 33N/46R/523D, 33N/46R/541A, 33N/46R/548K, 33N/103L/336V/518V/521D/548K, 33N/471Y/523D/541A, 37A, 37A/103L, 37A/103L/305E/336V, 37A/103L/305E/336V/521D/523D/540R/548K, 37A/103L/305E/336V/523D/540R, 37A/103L/305E/471Y, 37A/103L/305E/471Y/540R/548K, 37A/103L/305E/521D/541A/548K, 37A/103L/305E/540R, 37A/103L/328Q/336V/518V/523D/548K, 37A/103L/328Q/521D/541A/548K, 37A/103L/336V, 37A/103L/336V/521D/541A, 37A/103L/519P/541A/548K, 37A/103L/540R, 37A/103L/541A/548K, 37A/305E, 37A/305E/336V, 37A/305E/336V/521D/540R/548K, 37A/305E/336V/523D/548K, 37A/305E/336V/540R/548K, 37A/305E/336V/541A/548K, 37A/305E/471Y, 37A/305E/471Y/523D/540R/548K, 37A/305E/471Y/540R/548K, 37A/305E/519P/548K, 37A/305E/521D/523D/540R/548K, 37A/305E/521D/540R, 37A/305E/521D/541A/548K, 37A/305E/523D/541A/548K, 37A/305E/541A, 37A/305E/541A/548K, 37A/305E/548K, 37A/336V, 37A/336V/471Y/541A/548K, 37A/336V/521D/523D, 37A/336V/521D/523D/548K, 37A/336V/523D/548K, 37A/336V/540R, 37A/336V/548K, 37A/471Y, 37A/471Y/518V, 37A/471Y/518V/519P/523D, 37A/471Y/521D/540R/548K, 37A/519P, 37A/521D/523D/548K, 37A/521D/540R, 37A/523D/541A, 37A/523D/548K, 37A/540R, 37A/540R/548K, 37A/541A, 37A/548K, 46R, 46R/49D/59A/111K/523D/531D/549D, 46R/49D/111K/234Y/289Q/436V/549D, 46R/49D/111K/234Y/289Q/531D/549D, 46R/49D/111K/234Y/336V, 46R/49D/111K/234Y/336V/523D/549D, 46R/49D/111K/336V/549D, 46R/49D/234Y/289Q/336V, 46R/49D/234Y/336V/521D/523D/549D, 46R/49D/234Y/540R/549D, 46R/49D/234Y/549D, 46R/49D/289Q/523D/531D/549D/562S, 46R/49D/531D/549D, 46R/59A/234Y, 46R/59A/549D/562S, 46R/103L/305E, 46R/103L/305E/336V/471Y/540R/548K, 46R/103L/305E/336V/523D, 46R/103L/305E/471Y/540R/548K, 46R/103L/305E/520Q/540R, 46R/103L/305E/548K, 46R/103L/523D/548K, 46R/103L/540R/548K, 46R/103L/541A, 46R/103L/541A/548K, 46R/103L/548K, 46R/111K/234Y/289Q/531D/549D, 46R/111K/234Y/521D/549D, 46R/111K/523D/531D/549D, 46R/234Y/289Q/549S, 46R/234Y/521D/523D/531D/540R/549D, 46R/234Y/549D, 46R/289Q/549D, 46R/305E, 46R/305E/336V, 46R/305E/336V/518V, 46R/305E/336V/522E, 46R/305E/336V/548K, 46R/305E/471Y, 46R/305E/523D/548K, 46R/305E/548K, 46R/336V/521D/523D, 46R/336V/523D/548K, 46R/336V/540R, 46R/336V/540R/548K, 46R/521D/523D, 46R/521D/523D/540R, 46R/521D/523D/549D, 46R/521D/548K, 46R/523D/540R, 46R/523D/541A/548K, 46R/541A, 46R/541A/548K, 46R/548K, 46R/549D, 49D, 49D/59A/111K/234Y/289Q/521D, 49D/59A/111K/289Q/523D, 49D/59A/234Y/289Q/336V, 49D/59A/234Y/289Q/336V/523D/531D/549D, 49D/59A/289Q/305E/336V, 49D/59A/289Q/336V, 49D/59A/336V, 49D/59A/521D/531D, 49D/111K, 49D/111K/234Y, 49D/111K/234Y/289Q/336V/523D/531D/549D, 49D/111K/234Y/289Q/521D/523D/531D/549D/562S, 49D/111K/234Y/289Q/523D/549D, 49D/111K/234Y/336V/521D/523D, 49D/111K/234Y/336V/523D/531D, 49D/111K/234Y/523D/531D/549D, 49D/111K/234Y/531D, 49D/111K/234Y/549D, 49D/111K/289Q, 49D/111K/289Q/336V/521D/549D, 49D/111K/523D/531D/549D, 49D/111K/531D/549D, 49D/234Y, 49D/234Y/289Q, 49D/234Y/289Q/336V/531D/549D, 49D/234Y/289Q/523D, 49D/234Y/289Q/523D/531D/540R, 49D/234Y/289Q/523D/549D, 49D/234Y/305E/549D, 49D/234Y/521D, 49D/234Y/549D, 49D/289Q/305E/336V/523D, 49D/289Q/336V, 49D/289Q/336V/521D/531D, 49D/336V/521D/562S, 49D/521D/531D/549D/562S, 49D/521D/549D, 49D/523D/549D, 49D/549D, 59A, 59A/111K/234Y/289Q/305E/336V/549D, 59A/111K/234Y/289Q/305E/549D, 59A/111K/289Q, 59A/111K/336V, 59A/549D, 103L, 103L/336V/519P/548K, 103L/521D/523D/540R, 111K/234Y/289Q, 111K/234Y/289Q/523D, 111K/289Q/336V/521D, 111K/289Q/336V/523D/549D, 111K/336V/562S, 111K/521D/523D/549D, 234Y, 234Y/289Q, 234Y/289Q/336V/523D, 234Y/289Q/523D/531D/549D/562S, 234Y/289Q/523D/549D, 234Y/289Q/531D, 234Y/289Q/549D, 234Y/336V, 234Y/336V/531D/562S, 234Y/521D/523D, 234Y/521D/523D/549D, 234Y/523D/531D, 234Y/531D/549D, 234Y/540R, 234Y/549D, 234Y/562S, 289Q, 289Q/336V/549D, 289Q/521D/523D, 289Q/521D/523D/540R, 289Q/521D/523D/549D, 289Q/523D, 305E/336V/541A/548K, 336V/548K, 519P/548K, 521D, 521D/548K, 521D/549D, 521D/562S, 523D, 531D/549D, 540R, and 549D, wherein the positions are numbered with reference to SEQ ID NO: 736. In some embodiments, the tyrosine ammonia lyase comprises at least one substitution or substitution sets selected from K33N/Q37A, K33N/Q37A/L46R/Q305E, K33N/Q37A/R103L, K33N/Q37A/R103L/Q305E, K33N/Q37A/R103L/Q305E/I336V/L541A/S548K, K33N/Q37A/R103L/Q305E/E523D/S548K, K33N/Q37A/R103L/Q305E/S548K, K33N/Q37A/R103L/I336V/K518V/L541A/S548K, K33N/Q37A/R103L/Q471Y/A519P/S548K, K33N/Q37A/R103L/K518V/E523D/L541A, K33N/Q37A/R103L/A519P/E523D, K33N/Q37A/R103L/E523D, K33N/Q37A/R103L/A540R, K33N/Q37A/Q305E, K33N/Q37A/Q305E/A328Q, K33N/Q37A/Q305E/A328Q/S548K, K33N/Q37A/Q305E/I336V/Q471Y/L541A, K33N/Q37A/Q305E/I336V/K518V/E523D, K33N/Q37A/Q305E/I336V/S521D/E523D/S548K, K33N/Q37A/Q305E/I336V/S521D/S548K, K33N/Q37A/Q305E/I336V/L541A, K33N/Q37A/Q305E/Q471Y/S521D/S548K, K33N/Q37A/Q305E/E523D/A540R, K33N/Q37A/Q305E/A540R, K33N/Q37A/Q305E/L541A, K33N/Q37A/I336V, K33N/Q37A/I336V/A540R, K33N/Q37A/I336V/A540R/S548K, K33N/Q37A/Q471Y/E523D/A540R/S548K, K33N/Q37A/K518V/S521D/A540R, K33N/Q37A/K518V/S521D/S548K, K33N/Q37A/K518V/S548K, K33N/Q37A/S521D/S548K, K33N/Q37A/E523D, K33N/Q37A/E523D/A540R/S548K, K33N/Q37A/A540R, K33N/Q37A/S548K, K33N/L46R, K33N/L46R/Q66K/Q305E/S521D/E523D/A540R/S548K, K33N/L46R/R103L/Q305E/I336V/K518V/A519P/A540R, K33N/L46R/R103L/Q305E/I336V/S548K, K33N/L46R/R103L/Q305E/A540R, K33N/L46R/R103L/A540R/S548K, K33N/L46R/Q305E, K33N/L46R/Q305E/I336V, K33N/L46R/Q305E/K518V/A540R/S548K, K33N/L46R/I336V/Q471Y/A519P/E523D/S548K, K33N/L46R/I336V/S521D, K33N/L46R/I336V/S521D/E523D, K33N/L46R/I336V/A540R, K33N/L46R/I336V/A540R/S548K, K33N/L46R/K518V/S521D/S548K, K33N/L46R/S521D/S548K, K33N/L46R/E523D, K33N/L46R/L541A, K33N/L46R/S548K, K33N/R103L/I336V/K518V/S521D/S548K, K33N/Q471Y/E523D/L541A, Q37A, Q37A/R103L, Q37A/R103L/Q305E/I336V, Q37A/R103L/Q305E/I336V/S521D/E523D/A540R/S548K, Q37A/R103L/Q305E/I336V/E523D/A540R, Q37A/R103L/Q305E/Q471Y, Q37A/R103L/Q305E/Q471Y/A540R/S548K, Q37A/R103L/Q305E/S521D/L541A/S548K, Q37A/R103L/Q305E/A540R, Q37A/R103L/A328Q/I336V/K518V/E523D/S548K, Q37A/R103L/A328Q/S521D/L541A/S548K, Q37A/R103L/I336V, Q37A/R103L/I336V/S521D/L541A, Q37A/R103L/A519P/L541A/S548K, Q37A/R103L/A540R, Q37A/R103L/L541A/S548K, Q37A/Q305E, Q37A/Q305E/I336V, Q37A/Q305E/I336V/S521D/A540R/S548K, Q37A/Q305E/I336V/E523D/S548K, Q37A/Q305E/I336V/A540R/S548K, Q37A/Q305E/I336V/L541A/S548K, Q37A/Q305E/Q471Y, Q37A/Q305E/Q471Y/E523D/A540R/S548K, Q37A/Q305E/Q471Y/A540R/S548K, Q37A/Q305E/A519P/S548K, Q37A/Q305E/S521D/E523D/A540R/S548K, Q37A/Q305E/S521D/A540R, Q37A/Q305E/S521D/L541A/S548K, Q37A/Q305E/E523D/L541A/S548K, Q37A/Q305E/L541A, Q37A/Q305E/L541A/S548K, Q37A/Q305E/S548K, Q37A/I336V, Q37A/I336V/Q471Y/L541A/S548K, Q37A/I336V/S521D/E523D, Q37A/I336V/S521D/E523D/S548K, Q37A/I336V/E523D/S548K, Q37A/I336V/A540R, Q37A/I336V/S548K, Q37A/Q471Y, Q37A/Q471Y/K518V, Q37A/Q471Y/K518V/A519P/E523D, Q37A/Q471Y/S521D/A540R/S548K, Q37A/A519P, Q37A/S521D/E523D/S548K, Q37A/S521D/A540R, Q37A/E523D/L541A, Q37A/E523D/S548K, Q37A/A540R, Q37A/A540R/S548K, Q37A/L541A, Q37A/S548K, L46R, L46R/T49D/S59A/Q111K/E523D/N531D/G549D, L46R/T49D/Q111K/H234Y/R289Q/L436V/G549D, L46R/T49D/Q111K/H234Y/R289Q/N531D/G549D, L46R/T49D/Q111K/H234Y/I336V, L46R/T49D/Q111K/H234Y/I336V/E523D/G549D, L46R/T49D/Q111K/I336V/G549D, L46R/T49D/H234Y/R289Q/I336V, L46R/T49D/H234Y/I336V/S521D/E523D/G549D, L46R/T49D/H234Y/A540R/G549D, L46R/T49D/H234Y/G549D, L46R/T49D/R289Q/E523D/N531D/G549D/I562S, L46R/T49D/N531D/G549D, L46R/S59A/H234Y, L46R/S59A/G549D/I562S, L46R/R103L/Q305E, L46R/R103L/Q305E/I336V/Q471Y/A540R/S548K, L46R/R103L/Q305E/I336V/E523D, L46R/R103L/Q305E/Q471Y/A540R/S548K, L46R/R103L/Q305E/P520Q/A540R, L46R/R103L/Q305E/S548K, L46R/R103L/E523D/S548K, L46R/R103L/A540R/S548K, L46R/R103L/L541A, L46R/R103L/L541A/S548K, L46R/R103L/S548K, L46R/Q111K/H234Y/R289Q/N531D/G549D, L46R/Q111K/H234Y/S521D/G549D, L46R/Q111K/E523D/N531D/G549D, L46R/H234Y/R289Q/G549S, L46R/H234Y/S521D/E523D/N531D/A540R/G549D, L46R/H234Y/G549D, L46R/R289Q/G549D, L46R/Q305E, L46R/Q305E/I336V, L46R/Q305E/I336V/K518V, L46R/Q305E/I336V/K522E, L46R/Q305E/I336V/S548K, L46R/Q305E/Q471Y, L46R/Q305E/E523D/S548K, L46R/Q305E/S548K, L46R/I336V/S521D/E523D, L46R/I336V/E523D/S548K, L46R/I336V/A540R, L46R/I336V/A540R/S548K, L46R/S521D/E523D, L46R/S521D/E523D/A540R, L46R/S521D/E523D/G549D, L46R/S521D/S548K, L46R/E523D/A540R, L46R/E523D/L541A/S548K, L46R/L541A, L46R/L541A/S548K, L46R/S548K, L46R/G549D, T49D, T49D/S59A/Q111K/H234Y/R289Q/S521D, T49D/S59A/Q111K/R289Q/E523D, T49D/S59A/H234Y/R289Q/I336V, T49D/S59A/H234Y/R289Q/I336V/E523D/N531D/G549D, T49D/S59A/R289Q/Q305E/I336V, T49D/S59A/R289Q/I336V, T49D/S59A/I336V, T49D/S59A/S521D/N531D, T49D/Q111K, T49D/Q111K/H234Y, T49D/Q111K/H234Y/R289Q/I336V/E523D/N531D/G549D, T49D/Q111K/H234Y/R289Q/S521D/E523D/N531D/G549D/I562S, T49D/Q111K/H234Y/R289Q/E523D/G549D, T49D/Q111K/H234Y/I336V/S521D/E523D, T49D/Q111K/H234Y/I336V/E523D/N531D, T49D/Q111K/H234Y/E523D/N531D/G549D, T49D/Q111K/H234Y/N531D, T49D/Q111K/H234Y/G549D, T49D/Q111K/R289Q, T49D/Q111K/R289Q/I336V/S521D/G549D, T49D/Q111K/E523D/N531D/G549D, T49D/Q111K/N531D/G549D, T49D/H234Y, T49D/H234Y/R289Q, T49D/H234Y/R289Q/I336V/N531D/G549D, T49D/H234Y/R289Q/E523D, T49D/H234Y/R289Q/E523D/N531D/A540R, T49D/H234Y/R289Q/E523D/G549D, T49D/H234Y/Q305E/G549D, T49D/H234Y/S521D, T49D/H234Y/G549D, T49D/R289Q/Q305E/I336V/E523D, T49D/R289Q/I336V, T49D/R289Q/I336V/S521D/N531D, T49D/I336V/S521D/I562S, T49D/S521D/N531D/G549D/I562S, T49D/S521D/G549D, T49D/E523D/G549D, T49D/G549D, S59A, S59A/Q111K/H234Y/R289Q/Q305E/I336V/G549D, S59A/Q111K/H234Y/R289Q/Q305E/G549D, S59A/Q111K/R289Q, S59A/Q111K/I336V, S59A/G549D, R103L, R103L/I336V/A519P/S548K, R103L/S521D/E523D/A540R, Q111K/H234Y/R289Q, Q111K/H234Y/R289Q/E523D, Q111K/R289Q/I336V/S521D, Q111K/R289Q/I336V/E523D/G549D, Q111K/I336V/S548K, Q111K/S521D/E523D/G549D, H234Y, H234Y/R289Q, H234Y/R289Q/I336V/E523D, H234Y/R289Q/E523D/N531D/G549D/I562S, H234Y/R289Q/E523D/G549D, H234Y/R289Q/N531D, H234Y/R289Q/G549D, H234Y/I336V, H234Y/I336V/ N531D/I562S, H234Y/S521D/E523D, H234Y/S521D/ E523D/G549D, H234Y/E523D/N531D, H234Y/N531D/ G549D, H234Y/A540R, H234Y/G549D, H234Y/I562S, R289Q, R289Q/I336V/G549D, R289Q/S521D/E523D, R289Q/S521D/E523D/A540R, R289Q/S521D/E523D/ G549D, R289Q/E523D, Q305E/I336V/L541A/S548K, I336V/S548K, A519P/S548K, S521D, S521D/S548K, S521D/G549D, S521D/I562S, E523D, N531D/G549D, A540R, and G549D, wherein the positions are numbered with reference to SEQ ID NO: 736.

In some embodiments, the tyrosine ammonia lyase comprises at least one substitution or substitution set at one or more amino acid positions selected from 24/44/464, 24/201/ 202/351/507, 24/202/351, 33/37/46/56/103/523/540/548/ 549, 33/37/46/56/111/234/523, 33/37/46/56/111/523/540, 33/37/46/103/111/234, 33/37/46/103/111/548/549, 33/37/ 46/103/523, 33/37/46/111/234/328/523/540/548, 33/37/46/ 111/336/540, 33/37/46/234/523, 33/37/46/336, 33/37/46/ 548/549, 33/37/56/111/234/523/540/548, 33/37/56/234/523/ 540/548, 33/37/103/111/234/336/540/548, 33/37/103/336/ 523/540/548, 33/37/111/234/523/540/548, 33/37/111/523/ 540, 33/37/111/548, 33/37/234/336/523/548, 33/37/523/ 540/548, 33/46, 33/46/56/111/548, 33/46/56/234/248/549, 33/46/103/523/549, 33/56/103/111, 33/103/111/234, 33/103/111/234/336/523/548, 33/103/111/234/540/549, 33/103/111/336, 33/111/234/548, 33/234/328/523/540/549, 33/234/336/523/540/548/549, 33/234/523/540/548, 33/234/ 523/548, 33/234/540/548/549, 33/336, 33/336/523/540/548/ 549, 33/336/540/548, 33/336/549, 37, 37/46/56/523, 37/46/ 234, 37/46/336/523/540/548, 37/46/336/540/548, 37/56/ 234/336/523/540/548/549, 37/56/336/523/540/548, 37/103/ 336/548/549, 37/111/523, 37/234/328/336/523, 37/336, 37/548/549, 44, 46/103/328/336/523, 46/103/336, 46/234/ 336, 46/234/540/548, 46/336/540/549, 202, 202/332/408, 234/523/540/548/549, 336/523, 408, and 523/548, wherein the positions are numbered with reference to SEQ ID NO: 790. In some embodiments, the tyrosine ammonia lyase comprises at least one substitution or substitution sets selected from 24T/44R/464Q, 24T/201N/202R/351N/507R, 24T/202R/351N, 33N/37A/46R/56G/103L/523D/540R/ 548K/549D, 33N/37A/46R/56G/111K/234Y/523D, 33N/ 37A/46R/56G/111K/523D/540R, 33N/37A/46R/103L/ 111K/234Y, 33N/37A/46R/103L/111K/548K/549D, 33N/ 37A/46R/103L/523D, 33N/37A/46R/111K/234Y/328Q/ 523D/540R/548K, 33N/37A/46R/111K/336V/540R, 33N/ 37A/46R/234Y/523D, 33N/37A/46R/336V, 33N/37A/46R/ 548K/549D, 33N/37A/56G/111K/234Y/523D/540R/548K, 33N/37A/56G/234Y/523D/540R/548K, 33N/37A/103L/ 111K/234Y/336V/540R/548K, 33N/37A/103L/336V/523D/ 540R/548K, 33N/37A/111K/234Y/523D/540R/548K, 33N/ 37A/111K/523D/540R, 33N/37A/111K/548K, 33N/37A/ 234Y/336V/523D/548K, 33N/37A/523D/540R/548K, 33N/ 46R, 33N/46R/56G/111K/548K, 33N/46R/56G/234Y/ 248V/549D, 33N/46R/103L/523D/549D, 33N/56G/103L/ 111K, 33N/103L/111K/234Y, 33N/103L/111K/234Y/336V/ 523D/548K, 33N/103L/111K/234Y/540R/549D, 33N/103L/ 111K/336V, 33N/111K/234Y/548K, 33N/234Y/328Q/ 523D/540R/549D, 33N/234Y/336V/523D/540R/548K/ 549D, 33N/234Y/523D/540R/548K, 33N/234Y/523D/ 548K, 33N/234Y/540R/548K/549D, 33N/336V, 33N/336V/ 523D/540R/548K/549D, 33N/336V/540R/548K, 33N/ 336V/549D, 37A, 37A/46R/56G/523D, 37A/46R/234Y, 37A/46R/336V/523D/540R/548K, 37A/46R/336V/540R/ 548K, 37A/56G/234Y/336V/523D/540R/548K/549D, 37A/ 56G/336V/523D/540R/548K, 37A/103L/336V/548K/549D, 37A/111K/523D, 37A/234Y/328Q/336V/523D, 37A/336V, 37A/548K/549D, 44R, 46R/103L/328Q/336V/523D, 46R/ 103L/336V, 46R/234Y/336V, 46R/234Y/540R/548K, 46R/ 336V/540R/549D, 202R, 202R/332Q/408E, 234Y/523D/ 540R/548K/549D, 336V/523D, 408E, and 523D/548K, wherein the positions are numbered with reference to SEQ ID NO: 790. In some embodiments, the tyrosine ammonia lyase comprises at least one substitution or substitution sets selected from I24T/K44R/R464Q, I24T/K201N/L202R/ G351N/Q507R, I24T/L202R/G351N, K33N/Q37A/L46R/ R56G/R103L/E523D/A540R/S548K/G549D, K33N/Q37A/ L46R/R56G/Q111K/H234Y/E523D, K33N/Q37A/L46R/ R56G/Q111K/E523D/A540R, K33N/Q37A/L46R/R103L/ Q111K/H234Y, K33N/Q37A/L46R/R103L/Q111K/S548K/ G549D, K33N/Q37A/L46R/R103L/E523D, K33N/Q37A/ L46R/Q111K/H234Y/A328Q/E523D/A540R/S548K, K33N/Q37A/L46R/Q111K/I336V/A540R, K33N/Q37A/ L46R/H234Y/E523D, K33N/Q37A/L46R/I336V, K33N/ Q37A/L46R/S548K/G549D, K33N/Q37A/R56G/Q111K/ H234Y/E523D/A540R/S548K, K33N/Q37A/R56G/ H234Y/E523D/A540R/S548K, K33N/Q37A/R103L/ Q111K/H234Y/I336V/A540R/S548K, K33N/Q37A/ R103L/I336V/E523D/A540R/S548K, K33N/Q37A/Q111K/ H234Y/E523D/A540R/S548K, K33N/Q37A/Q111K/ E523D/A540R, K33N/Q37A/Q111K/S548K, K33N/Q37A/ H234Y/I336V/E523D/S548K, K33N/Q37A/E523D/ A540R/S548K, K33N/L46R, K33N/L46R/R56G/Q111K/ S548K, K33N/L46R/R56G/H234Y/A248V/G549D, K33N/ L46R/R103L/E523D/G549D, K33N/R56G/R103L/Q111K, K33N/R103L/Q111K/H234Y, K33N/R103L/Q111K/ H234Y/I336V/E523D/S548K, K33N/R103L/Q111K/ H234Y/A540R/G549D, K33N/R103L/Q111K/I336V, K33N/Q111K/H234Y/S548K, K33N/H234Y/A328Q/ E523D/A540R/G549D, K33N/H234Y/I336V/E523D/ A540R/S548K/G549D, K33N/H234Y/E523D/A540R/ S548K, K33N/H234Y/E523D/S548K, K33N/H234Y/ A540R/S548K/G549D, K33N/I336V, K33N/I336V/E523D/ A540R/S548K/G549D, K33N/I336V/A540R/S548K, K33N/I336V/G549D, Q37A, Q37A/L46R/R56G/E523D, Q37A/L46R/H234Y, Q37A/L46R/I336V/E523D/A540R/ S548K, Q37A/L46R/I336V/A540R/S548K, Q37A/R56G/ H234Y/I336V/E523D/A540R/S548K/G549D, Q37A/ R56G/I336V/E523D/A540R/S548K, Q37A/R103L/I336V/ S548K/G549D, Q37A/Q111K/E523D, Q37A/H234Y/ A328Q/I336V/E523D, Q37A/I336V, Q37A/S548K/G549D, K44R, L46R/R103L/A328Q/I336V/E523D, L46R/R103L/ I336V, L46R/H234Y/I336V, L46R/H234Y/A540R/S548K, L46R/I336V/A540R/G549D, L202R, L202R/K332Q/ D408E, H234Y/E523D/A540R/S548K/G549D, I336V/ E523D, D408E, and E523D/S548K, wherein the positions are numbered with reference to SEQ ID NO: 790.

In some embodiments, the tyrosine ammonia lyase comprises at least one substitution or substitution set at one or more amino acid positions selected from 74, 102, 210, 313, 391, 392, 402, 415, 417, 418, 420, 424, 506, and 530, wherein the positions are numbered with reference to SEQ ID NO: 790. In some embodiments, the tyrosine ammonia lyase comprises at least one substitution or substitution sets selected from 74A, 102P, 210T, 313I, 313M, 391N, 392A, 402A, 415F, 417A, 418V, 420L, 424A, 506C, and 530V, wherein the positions are numbered with reference to SEQ ID NO: 790. In some embodiments, the tyrosine ammonia lyase comprises at least one substitution or substitution sets selected from I74A, M102P, L210T, L313I, L313M, T391N, M392A, S402A, L415F, G417A, L418V, I420L, S424A, R506C, and D530V, wherein the positions are numbered with reference to SEQ ID NO: 790.

In some embodiments, the tyrosine ammonia lyase comprises at least one substitution or substitution set at one or more amino acid positions selected from 24, 24/44, 24/44/46/202/391, 24/44/111/202/464/506, 24/44/202/313/391/540, 24/44/549, 24/46/102/313/506, 24/46/103/111/464/506/549, 24/46/103/391/506, 24/46/111/313/391, 24/46/111/313/549, 24/46/111/506, 24/46/202/391/506, 24/46/549, 24/103/202, 24/202, 44/46/102/202/313/417, 44/46/103/111/391, 44/46/103/202/313/391, 44/46/103/202/417/464, 44/103/111/313/391/540, 44/111/464/506, 46/103/506, 46/111/417, 46/111/506, 46/202, 46/202/506/549, 46/313/391/540, 103/313/549, 111, 111/202, 111/202/313/391/464, 111/202/313/391/506, 111/202/313/417/540/549, 111/202/391, 111/202/391/540, 111/464/540/549, 202/313/391/549, 202/417/464/540/549, 202/464/506, 202/506/540, 202/506/540/549, 313/391/540/549, and 417, wherein the positions are numbered with reference to SEQ ID NO: 1454. In some embodiments, the tyrosine ammonia lyase comprises at least one substitution or substitution sets selected from 24T, 24T/44R, 24T/44R/46R/202R/391N, 24T/44R/111K/202R/464Q/506C, 24T/44R/202R/313M/391N/540R, 24T/44R/549D, 24T/46R/102P/313M/506C, 24T/46R/103L/111K/464Q/506C/549D, 24T/46R/103L/391N/506C, 24T/46R/111K/313M/391N, 24T/46R/111K/313M/549D, 24T/46R/111K/506C, 24T/46R/202R/391N/506C, 24T/46R/549D, 24T/103L/202R, 24T/202R, 44R/46R/102P/202R/313M/417A, 44R/46R/103L/111K/391N, 44R/46R/103L/202R/313M/391N, 44R/46R/103L/202R/417A/464Q, 44R/103L/111K/313M/391N/540R, 44R/111K/464Q/506C, 46R/103L/506C, 46R/111K/417A, 46R/111K/506C, 46R/202R, 46R/202R/506C/549D, 46R/313M/391N/540R, 103L/313M/549D, 111K, 111K/202R, 111K/202R/313M/391N/464Q, 111K/202R/313M/391N/506C, 111K/202R/313M/417A/540R/549D, 111K/202R/391N, 111K/202R/391N/540R, 111K/464Q/540R/549D, 202R/313M/391N/549D, 202R/417A/464Q/540R/549D, 202R/464Q/506C, 202R/506C/540R, 202R/506C/540R/549D, 313M/391N/540R/549D, and 417A, wherein the positions are numbered with reference to SEQ ID NO: 1454. In some embodiments, the tyrosine ammonia lyase comprises at least one substitution or substitution sets selected from I24T, I24T/K44R, I24T/K44R/L46R/L202R/T391N, I24T/K44R/Q111K/L202R/R464Q/R506C, I24T/K44R/L202R/L313M/T391N/A540R, I24T/K44R/G549D, I24T/L46R/M102P/L313M/R506C, I24T/L46R/R103L/Q111K/R464Q/R506C/G549D, I24T/L46R/R103L/T391N/R506C, I24T/L46R/Q111K/L313M/T391N, I24T/L46R/Q111K/L313M/G549D, I24T/L46R/Q111K/R506C, I24T/L46R/L202R/T391N/R506C, I24T/L46R/G549D, I24T/R103L/L202R, I24T/L202R, K44R/L46R/M102P/L202R/L313M/G417A, K44R/L46R/R103L/Q111K/T391N, K44R/L46R/R103L/L202R/L313M/T391N, K44R/L46R/R103L/L202R/G417A/R464Q, K44R/R103L/Q111K/L313M/T391N/A540R, K44R/Q111K/R464Q/R506C, L46R/R103L/R506C, L46R/Q111K/G417A, L46R/Q111K/R506C, L46R/L202R, L46R/L202R/R506C/G549D, L46R/L313M/T391N/A540R, R103L/L313M/G549D, Q111K, Q111K/L202R, Q111K/L202R/L313M/T391N/R464Q, Q111K/L202R/L313M/T391N/R506C, Q111K/L202R/L313M/G417A/A540R/G549D, Q111K/L202R/T391N, Q111K/L202R/T391N/A540R, Q111K/R464Q/A540R/G549D, L202R/L313M/T391N/G549D, L202R/G417A/R464Q/A540R/G549D, L202R/R464Q/R506C, L202R/R506C/A540R, L202R/R506C/A540R/G549D, L313M/T391N/A540R/G549D, and G417A, wherein the positions are numbered with reference to SEQ ID NO: 1454.

In some embodiments, the tyrosine ammonia lyase comprises at least one substitution or substitution set at one or more amino acid positions selected from 20/44/202/506, 20/103/111/471/506, 20/202/313/471/506, 24, 27, 33, 36, 41, 44, 44/111/202/464/471/506/549, 44/202/464/506, 46, 48, 50, 51, 55, 56/111/506, 56/506, 59, 66, 66/528, 103/111/202/464/471, 103/111/471, 103/202/540, 103/464/549, 103/471, 111, 111/202/313/316, 111/202/313/471/506, 111/202/471, 111/506, 197, 202, 202/313/464/471/506, 202/464/506, 202/464/506/549, 208, 272, 289, 292/553, 305, 312/559, 313/464/471/506, 331, 332, 432, 435, 464, 464/506, 470, 500, 504, 506, 506/549, 518, 519, 523, 540, 543, 547, 547/553, 555, 556, and 559, wherein the positions are numbered with reference to SEQ ID NO: 1578. In some embodiments, the tyrosine ammonia lyase comprises at least one substitution or substitution sets selected from 20G/44R/202R/506R, 20G/103L/111K/471Y/506R, 20G/202R/313L/471Y/506R, 24E, 24K, 24Q, 24S, 27S, 33E, 36S, 36T, 41A, 41H, 41L, 41N, 41Q, 41S, 44E, 44P, 44R, 44R/111K/202R/464Q/471Y/506R/549D, 44R/202R/464Q/506R, 44S, 46A, 46S, 48A, 48G, 50M, 51A, 51H, 55S, 56G/111K/506R, 56G/506R, 59N, 59S, 66H/528R, 66K, 66N, 66T, 103L/111K/202R/464Q/471Y, 103L/111K/471Y, 103L/202R/540R, 103L/464Q/549D, 103L/471Y, 111K, 111K/202R/313L/316Q, 111K/202R/313L/471Y/506R, 111K/202R/471Y, 111K/506R, 197V, 202R, 202R/313L/464Q/471Y/506R, 202R/464Q/506R, 202R/464Q/506R/549D, 208M, 272A, 289L, 292L/535S, 305D, 305E, 312C/559Y, 313L/464Q/471Y/506R, 331G, 332N, 432L, 432T, 435A, 435T, 464N, 464Q/506R, 464S, 470I, 470T, 500L, 504A, 504L, 506E, 506R, 506R/549D, 518S, 519E, 519K, 519P, 519T, 523H, 540H, 540R, 543T, 543V, 547G, 547M/553I, 555S, 556L, 556V, 559C, 559H, 559I, 559L, 559M, and 559Y, wherein the positions are numbered with reference to SEQ ID NO: 1578. In some embodiments, the tyrosine ammonia lyase comprises at least one substitution or substitution sets selected from D20G/K44R/L202R/C506R, D20G/R103L/Q111K/Q471Y/C506R, D20G/L202R/M313L/Q471Y/C506R, T24E, T24K, T24Q, T24S, D27S, N33E, A36S, A36T, Y41A, Y41H, Y41L, Y41N, Y41Q, Y41S, K44E, K44P, K44R, K44R/Q111K/L202R/R464Q/Q471Y/C506R/G549D, K44R/L202R/R464Q/C506R, K44S, R46A, R465, T48A, T48G, K50M, E51A, E51H, Q55S, R56G/Q111K/C506R, R56G/C506R, A59N, A59S, Q66H/W528R, Q66K, Q66N, Q66T, R103L/Q111K/L202R/R464Q/Q471Y, R103L/Q111K/Q471Y, R103L/L202R/A540R, R103L/R464Q/G549D, R103L/Q471Y, Q111K, Q111K/L202R/M313L/L316Q, Q111K/L202R/M313L/Q471Y/C506R, Q111K/L202R/Q471Y, Q111K/C506R, P197V, L202R, L202R/M313L/R464Q/Q471Y/C506R, L202R/R464Q/C506R, L202R/R464Q/C506R/G549D, L208M, P272A, Q289L, R292L/V553S, Q305D, Q305E, S312C/V559Y, M313L/R464Q/Q471Y/C506R, A331G, K332N, Y432L, Y432T, S435A, S435T, R464N, R464Q/C506R, R4645, Q470I, Q470T, C500L, R504A, R504L, C506E, C506R, C506R/G549D, K518S, A519E, A519K, A519P, A519T, D523H, A540H, A540R, A543T, A543V, T547G, T547M/V553I, A555S, I556L, I556V, V559C, V559H, V559I, V559L, V559M, and V559Y, wherein the positions are numbered with reference to SEQ ID NO: 1578.

In some embodiments, the tyrosine ammonia lyase comprises at least one substitution or substitution set at one or more amino acid positions selected from 20, 20/44/208/272/519, 20/111/208/272/410/432, 20/197/432/519, 24, 24/46/410/435/518, 36/55/305/332/410, 36/66/197/305/332/457, 36/66/197/305/410, 36/66/305, 36/66/305/332/410, 36/66/305/500, 36/197/305, 36/197/305/332/410, 36/197/305/332/

410/500, 36/197/305/332/410/559, 36/197/305/332/500, 36/197/305/410, 36/197/305/500, 36/305, 36/305/332, 36/305/332/410, 36/305/410, 41/44/46/111/272, 41/432/526, 44/46/111/208, 44/46/111/432/519, 44/111/432/519/526, 44/208/432/435, 46/111/208/272/435/526, 46/208/272/432/435/526, 46/432/471, 55/305, 55/305/332/457/543/547, 55/305/500/559, 66/305, 66/305/332, 111, 111/272/432/435, 111/272/471/526, 111/272/519, 111/432/435, 111/432/526, 111/526, 134/202/305, 197/305, 197/305/332/410, 197/305/332/500/543/547, 197/305/410, 197/305/500, 208, 208/272/432, 208/410/435, 208/435/519, 211/410, 272, 272/435/526, 298/410, 305, 305/332, 305/332/410, 305/332/410/500, 305/332/457, 305/332/457/500, 305/332/457/555, 305/332/500, 305/410, 305/500/543/547, 410, 432/526, 435, 435/518, 435/519/526, 471, 471/526, and 519, wherein the positions are numbered with reference to SEQ ID NO: 1660. In some embodiments, the tyrosine ammonia lyase comprises at least one substitution or substitution sets selected from 20G, 20G/44E/208M/272A/519K, 20G/111K/208M/272A/410M/432T, 20G/197V/432T/519K, 24E, 24E/46S/410M/435T/518S, 36S/55S/305D/332N/410M, 36S/66N/197V/305D/332N/457S, 36S/66N/197V/305D/410M, 36S/66N/305D, 36S/66N/305D/332N/410M, 36S/66N/305D/500L, 36S/197V/305D, 36S/197V/305D/332N/410M, 36S/197V/305D/332N/410M/500L, 36S/197V/305D/332N/410M/559I, 36S/197V/305D/332N/500L, 36S/197V/305D/410M, 36S/197V/305D/500L, 36S/305D, 36S/305D/332N, 36S/305D/332N/410M, 36S/305D/410M, 41L/44E/46S/111K/272A, 41L/432T/526L, 44E/46S/111K/208M, 44E/46S/111K/432T/519K, 44E/111K/432L/519K/526L, 44E/208M/432T/435T, 46S/111K/208M/272A/435T/526L, 46S/208M/272A/432L/435T/526L, 46S/432L/471Y, 55S/305D, 55S/305D/332N/457S/543V/547G, 55S/305D/500L/559I, 66N/305D, 66N/305D/332N, 111K, 111K/272A/432T/435T, 111K/272A/471Y/526L, 111K/272A/519K, 111K/432L/435T, 111K/432T/526L, 111K/526L, 134C/202L/305D, 197V/305D, 197V/305D/332N/410M, 197V/305D/332N/500L/543V/547G, 197V/305D/410M, 197V/305D/500L, 208M, 208M/272A/432L, 208M/410M/435T, 208M/435T/519K, 211Q/410I, 272A, 272A/435T/526L, 298G/410I, 305D, 305D/332N, 305D/332N/410M, 305D/332N/410M/500L, 305D/332N/457S, 305D/332N/457S/500L, 305D/332N/457S/555S, 305D/332N/500L, 305D/410M, 305D/500L/543V/547G, 410L, 432L/526L, 435T, 435T/518S, 435T/519K/526L, 471Y, 471Y/526L, and 519K, wherein the positions are numbered with reference to SEQ ID NO: 1660. In some embodiments, the tyrosine ammonia lyase comprises at least one substitution or substitution sets selected from D20G, D20G/K44E/L208M/P272A/A519K, D20G/Q111K/L208M/P272A/P410M/Y432T, D20G/P197V/Y432T/A519K, T24E, T24E/R46S/P410M/S435T/K518S, A36S/Q55S/Q305D/K332N/P410M, A36S/Q66N/P197V/Q305D/K332N/G457S, A36S/Q66N/P197V/Q305D/P410M, A36S/Q66N/Q305D, A36S/Q66N/Q305D/K332N/P410M, A36S/Q66N/Q305D/C500L, A36S/P197V/Q305D, A36S/P197V/Q305D/K332N/P410M, A36S/P197V/Q305D/K332N/P410M/C500L, A36S/P197V/Q305D/K332N/P410M/V559I, A36S/P197V/Q305D/K332N/C500L, A36S/P197V/Q305D/P410M, A36S/P197V/Q305D/C500L, A36S/Q305D, A36S/Q305D/K332N, A36S/Q305D/K332N/P410M, A36S/Q305D/P410M, Y41L/K44E/R46S/Q111K/P272A, Y41L/Y432T/Y526L, K44E/R46S/Q111K/L208M, K44E/R46S/Q111K/Y432T/A519K, K44E/Q111K/Y432L/A519K/Y526L, K44E/L208M/Y432T/S435T, R46S/Q111K/L208M/P272A/S435T/Y526L, R46S/L208M/P272A/Y432L/S435T/Y526L, R46S/Y432L/Q471Y, Q55S/Q305D, Q55S/Q305D/K332N/G457S/A543V/T547G, Q55S/Q305D/C500L/V559I, Q66N/Q305D, Q66N/Q305D/K332N, Q111K, Q111K/P272A/Y432T/S435T, Q111K/P272A/Q471Y/Y526L, Q111K/P272A/A519K, Q111K/Y432L/S435T, Q111K/Y432T/Y526L, Q111K/Y526L, S134C/R202L/Q305D, P197V/Q305D, P197V/Q305D/K332N/P410M, P197V/Q305D/K332N/C500L/A543V/T547G, P197V/Q305D/P410M, P197V/Q305D/C500L, L208M, L208M/P272A/Y432L, L208M/P410M/S435T, L208M/S435T/A519K, L211Q/P410I, P272A, P272A/S435T/Y526L, S298G/P410I, Q305D, Q305D/K332N, Q305D/K332N/P410M, Q305D/K332N/P410M/C500L, Q305D/K332N/G457S, Q305D/K332N/G457S/C500L, Q305D/K332N/G457S/A555S, Q305D/K332N/C500L, Q305D/P410M, Q305D/C500L/A543V/T547G, P410L, Y432L/Y526L, S435T, S435T/K518S, S435T/A519K/Y526L, Q471Y, Q471Y/Y526L, and A519K, wherein the positions are numbered with reference to SEQ ID NO: 1660.

In some embodiments, the tyrosine ammonia lyase comprises at least one substitution or substitution set at one or more amino acid positions selected from 24/59/111/289/504, 24/111/289, 24/111/289/500/504, 24/111/432, 24/111/435/500, 24/289, 24/432/435/504, 41/44/208/547, 41/51/410/543, 41/208/410/543/547, 41/208/518/519/547, 41/208/547, 41/410/518/543, 41/410/518/547, 41/543, 44/208/518/547, 51/519, 59/66/111/289/432/500, 59/66/111/432/500, 59/66/111/432/504, 59/66/289/500/504/556, 59/111, 59/111/432/500, 59/289, 59/289/435, 59/432, 59/432/435/504/556, 66/111, 111, 111/289, 111/289/435, 111/289/435/500, 111/289/500, 111/331/432/504, 111/331/435/500, 111/432, 111/432/500, 111/500/504, 208, 208/211/410/519, 208/211/547, 211, 211/518/519/547, 211/547, 289, 289/432, 289/432/435, 289/435, 289/435/500/504, 289/435/504/556, 289/504, 410, 432, 435/504, 504, 504/556, 519, and 547, wherein the positions are numbered with reference to SEQ ID NO: 1844.

In some embodiments, the tyrosine ammonia lyase comprises at least one substitution or substitution sets selected from 24K/59S/111K/289L/504A, 24K/111K/289L, 24K/111K/289L/500L/504A, 24K/111K/432L, 24K/111K/435T/500L, 24K/289L, 24K/432L/435T/504A, 41Q/44P/208M/547G, 41Q/51A/410L/543V, 41Q/208M/410L/543V/547G, 41Q/208M/518S/519T/547G, 41Q/208M/547G, 41Q/410L/518S/543V, 41Q/410L/518S/547G, 41Q/543V, 44R/208M/518S/547G, 51A/519T, 59S/66T/111K/289L/432L/500L, 59S/66T/111K/432L/500L, 59S/66T/111K/432L/504A, 59S/66T/289L/500L/504A/556L, 59S/111K, 59S/111K/432L/500L, 59S/289L, 59S/289L/435T, 59S/432L, 59S/432L/435T/504A/556L, 66T/111K, 111K, 111K/289L, 111K/289L/435T, 111K/289L/435T/500L, 111K/289L/500L, 111K/331G/432L/504A, 111K/331G/435T/500L, 111K/432L, 111K/432L/500L, 111K/500L/504A, 208M, 208M/211Q/410L/519T, 208M/211Q/547G, 211Q, 211Q/518S/519T/547G, 211Q/547G, 289L, 289L/432L, 289L/432L/435T, 289L/435T, 289L/435T/500L/504A, 289L/435T/504A/556L, 289L/504A, 410L, 432L, 435T/504A, 504A, 504A/556L, 519T, and 547G, wherein the positions are numbered with reference to SEQ ID NO: 1844. In some embodiments, the tyrosine ammonia lyase comprises at least one substitution or substitution sets selected from T24K/A59S/Q111K/Q289L/R504A, T24K/Q111K/Q289L, T24K/Q111K/Q289L/C500L/R504A, T24K/Q111K/Y432L, T24K/Q111K/S435T/C500L, T24K/Q289L, T24K/Y432L/S435T/R504A, Y41Q/K44P/L208M/T547G, Y41Q/E51A/M410L/A543V, Y41Q/L208M/M410L/A543V/T547G, Y41Q/L208M/K518S/A519T/T547G, Y41Q/L208M/T547G, Y41Q/M410L/K518S/A543V, Y41Q/M410L/K518S/T547G, Y41Q/A543V, K44R/L208M/K518S/

T547G, E51A/A519T, A59S/Q66T/Q111K/Q289L/Y432L/ C500L, A59S/Q66T/Q111K/Y432L/C500L, A59S/Q66T/ Q111K/Y432L/R504A, A59S/Q66T/Q289L/C500L/ R504A/I556L, A59S/Q111K, A59S/Q111K/Y432L/C500L, A59S/Q289L, A59S/Q289L/S435T, A59S/Y432L, A59S/ Y432L/S435T/R504A/I556L, Q66T/Q111K, Q111K, Q111K/Q289L, Q111K/Q289L/S435T, Q111K/Q289L/ S435T/C500L, Q111K/Q289L/C500L, Q111K/A331G/ Y432L/R504A, Q111K/A331G/S435T/C500L, Q111K/ Y432L, Q111K/Y432L/C500L, Q111K/C500L/R504A, L208M, L208M/L211Q/M410L/A519T, L208M/L211Q/ T547G, L211Q, L211Q/K518S/A519T/T547G, L211Q/ T547G, Q289L, Q289L/Y432L, Q289L/Y432L/S435T, Q289L/S435T, Q289L/S435T/C500L/R504A, Q289L/ S435T/R504A/I556L, Q289L/R504A, M410L, Y432L, S435T/R504A, R504A, R504A/I556L, A519T, and T547G, wherein the positions are numbered with reference to SEQ ID NO: 1844.

In some embodiments, the tyrosine ammonia lyase comprises at least one substitution or substitution set at one or more amino acid positions selected from 4, 8, 11, 13, 13/22/45/512, 13/45, 13/45/512, 17, 19, 45, 45/244/324/513, 45/436/512/513, 45/512, 144, 251, 324, 327, 341, and 428, wherein the positions are numbered with reference to SEQ ID NO: 2030. In some embodiments, the tyrosine ammonia lyase comprises at least one substitution or substitution sets selected from 4D, 8D, 8G, 8R, 11A, 11D, 11G, 11K, 11S, 13Q/45V/512V, 13R, 13S/22T/45V/512V, 13S/45V, 17Q, 19H, 45V, 45V/244M/324V/513R, 45V/436I/512V/513R, 45V/512V, 144L, 251V, 324R, 327M, 341A, and 428V, wherein the positions are numbered with reference to SEQ ID NO: 2030. In some embodiments, the tyrosine ammonia lyase comprises at least one substitution or substitution sets selected from A4D, Q8D, Q8G, Q8R, T11A, T11D, T11G, T11K, T11S, K13Q/A45V/I512V, K13R, K13S/V22T/ A45V/I512V, K13S/A45V, T17Q, S19H, A45V, A45V/ L244M/A324V/K513R, A45V/L436I/I512V/K513R, A45V/I512V, I144L, L251V, A324R, I327M, V341A, and L428V, wherein the positions are numbered with reference to SEQ ID NO: 2030.

In some embodiments, the tyrosine ammonia lyase comprises at least one substitution or substitution set at one or more amino acid positions selected from 2, 4, 4/8/11/13/22/ 111/504, 4/8/11/17/324/428/504, 4/8/11/22/111, 4/8/22/111/ 504, 4/17/241/519/547, 4/324, 4/428, 6, 7, 8/11/13/324, 8/11/17/22/324/504/519, 8/11/111/504, 10, 11/13/504, 11/17/22/324, 14, 16, 39, 57, 228, 228/259, 236, 305/307/ 425, 316, 385, 425, 430, 437, 478, and 505, wherein the positions are numbered with reference to SEQ ID NO: 2114.

In some embodiments, the tyrosine ammonia lyase comprises at least one substitution or substitution sets selected from 2G, 2T, 4D, 4D/8D/11G/17P/324V/428V/504A, 4D/8D/22T/111K/504A, 4D/8R/11D/13R/22T/111K/504A, 4D/8R/11D/22T/111K, 4D/17Q/241S/519T/547A, 4D/324V, 4D/428V, 6G, 7Q, 8D/11D/13R/324V, 8D/11D/ 17Q/22T/324V/504A/519T, 8D/11D/111K/504A, 10G, 11D/17Q/22T/324V, 11G/13R/504A, 14G, 16Q, 16T, 39S, 57I, 228M, 228M/259H, 236V, 305E/307N/425V, 316T, 385A, 425V, 430E, 437G, 478L, and 505S, wherein the positions are numbered with reference to SEQ ID NO: 2114. In some embodiments, the tyrosine ammonia lyase comprises at least one substitution or substitution sets selected from I2G, I2T, A4D, A4D/Q8D/T11G/T17P/A324V/ L428V/R504A, A4D/Q8D/V22T/Q111K/R504A, A4D/ Q8R/T11D/K13R/V22T/Q111K/R504A, A4D/Q8R/T11D/ V22T/Q111K, A4D/T17Q/A241S/A519T/T547A, A4D/ A324V, A4D/L428V, Q6G, T7Q, Q8D/T11D/K13R/A324V, Q8D/T11D/T17Q/V22T/A324V/R504A/A519T, Q8D/ T11D/Q111K/R504A, F10G, T11D/T17Q/V22T/A324V, T11G/K13R/R504A, S14G, H16Q, H16T, A39S, V57I, I228M, I228M/Q259H, A236V, D305E/I307N/I425V, L316T, V385A, I425V, T430E, T437G, M478L, and T505S, wherein the positions are numbered with reference to SEQ ID NO: 2114.

In some embodiments, the tyrosine ammonia lyase comprises at least one substitution or substitution set at one or more amino acid positions selected from 4/7/57/111, 4/7/ 111/114/437/547, 4/16/385/478, 4/57/111/437, 7/385/547, 10/16/437, 16, 16/41/57/111/385/547, 16/41/57/437/478, 16/41/437, 16/57, 16/241/437, 16/385, 16/385/437, 16/385/ 478/547, 16/437, 20/385/437/478/547, 57, 57/111/114, 57/111/478/547, 57/437, 111/114/202/234/289/305/313/ 324/332/336/410/432/435/464/504/512/519/523/548/549, 111/241/437/478, 111/478, 241, 241/385, 241/385/478, 241/ 385/478/547, 241/437, 385, 385/437, 385/437/478/547, 437, 437/478, and 478, wherein the positions are numbered with reference to SEQ ID NO: 2156.

In some embodiments, the tyrosine ammonia lyase comprises at least one substitution or substitution sets selected from 4D/7Q/57I/111K, 4D/7Q/111K/114S/437G/547G, 4D/16Q/385A/478L, 4D/57I/111K/437G, 7Q/385A/547G, 10G/16Q/437G, 16Q, 16Q/41Q/57I/111K/385A/547G, 16Q/41Q/57I/437G/478L, 16Q/41Q/437G, 16Q/57I, 16Q/ 241S/437G, 16Q/385A, 16Q/385A/437G, 16Q/385A/478L/ 547G, 16Q/437G, 20G/385A/437G/478L/547G, 57I, 57I/ 111K/114S, 57I/111K/478L/547G, 57I/437G, 111K/114S/ 202L/234H/289Q/305Q/313L/324A/332K/S36I/410P/ 432Y/435S/464R/504R/512I/519A/523E/548S/549G, 111K/241S/437G/478L, 111K/478L, 241S, 241S/385A, 241S/385A/478L, 241S/385A/478L/547G, 241S/437G, 385A, 385A/437G, 385A/437G/478L/547G, 437G, 437G/ 478L, and 478L, wherein the positions are numbered with reference to SEQ ID NO: 2156.

In some embodiments, the tyrosine ammonia lyase comprises at least one substitution or substitution sets selected from A4D/T7Q/V57I/Q111K, A4D/T7Q/Q111K/P114S/ T437G/T547G, A4D/H16Q/V385A/M478L, A4D/V57I/ Q111K/T437G, T7Q/V385A/T547G, F10G/H16Q/T437G, H16Q, H16Q/Y41Q/V57I/Q111K/V385A/T547G, H16Q/ Y41Q/V57I/T437G/M478L, H16Q/Y41Q/T437G, H16Q/ V57I, H16Q/A241S/T437G, H16Q/V385A, H16Q/V385A/ T437G, H16Q/V385A/M478L/T547G, H16Q/T437G, D20G/V385A/T437G/M478L/T547G, V57I, V57I/Q111K/ P114S, V57I/Q111K/M478L/T547G, V57I/T437G, Q111K/ P114S/R202L/Y234H/L289Q/D305Q/M313L/V324A/ N332K/V336I/M410P/L432Y/T435S/Q464R/A504R/ V512I/T519A/D523E/K548S/D549G, Q111K/A241S/ T437G/M478L, Q111K/M478L, A241S, A241S/V385A, A241S/V385A/M478L, A241S/V385A/M478L/T547G, A241S/T437G, V385A, V385A/T437G, V385A/T437G/ M478L/T547G, T437G, T437G/M478L, and M478L, wherein the positions are numbered with reference to SEQ ID NO: 2156.

The present invention also provides the variants provided in Tables 1-1, 2-1, 3-1, 4-1, 5-1, 6-1, 7-1, 8-1, 9-1, 9-2, 10-1, 10-2, 11-1, 12-1, 13-1, 14-1, 15-1, 16-1, and/or 17-1. In some embodiments, the variant comprises at least about 80%, 85%, 90%, 91%, 92%, 93%, 94%, 95%, 96%, 97%, 98%, or 99% sequence identity to SEQ ID NO: 2. In some embodiments, the recombinant tyrosine lyase variant comprises at least 80%, 85%, 90%, 91%, 92%, 93%, 94%, 95%, 96%, 97%, 98%, or 99% sequence identity to SEQ ID NO: 2. In some additional embodiments, the recombinant tyrosine lyase variant comprises at least 90% sequence identity to at least one of the even numbered sequences in SEQ ID NOS: 10-2290. In some additional embodiments, the polypeptide of the recombinant tyrosine ammonia lyase variant comprises one of the even-numbered sequences of SEQ ID NOS: 10-2290. In some further embodiments, the recombinant tyrosine ammonia lyase comprises a sequence that is at least 80%, 85%, 90%, 91%, 92%, 93%, 94%, 95%, 96%, 97%, 98%, or 99% identical to the polypeptide sequence of SEQ ID NO: 2, 14, 86, 334, 388, 604, 736, 790, 1454, 1578, 1660, 1844, 2030, 2114, and/or 2156.

In some additional embodiments, the recombinant tyrosine ammonia lyase provided herein is thermostable. In some further embodiments, the recombinant tyrosine ammonia lyase is resistant to proteolysis. In yet some additional embodiments, the recombinant tyrosine ammonia lyase is resistant to at least one digestive tract protease. In some embodiments, the digestive tract protease is selected from chymotrypsin, trypsin, carboxypeptidases, and elastases. In some further embodiments, the recombinant tyrosine ammonia lyase is acid stable. In some additional embodiments, the recombinant tyrosine ammonia lyase is acid stable and resistant to proteolysis. In yet some additional embodiments, the recombinant tyrosine ammonia lyase is purified. In some further embodiments, the recombinant tyrosine ammonia lyase exhibits at least one improved property selected from: i) enhanced catalytic activity; ii) reduced sensitivity to proteolysis; iii) increased tolerance to acidic pH; iv) reduced aggregation; v) decreased Km for tyrosine; vi) decreased immunogenicity; or a combination of any of i), ii), iii), iv), v), and/or vi), as compared to a reference sequence. In some embodiments, the reference sequence is selected from SEQ ID NO: 2, 14, 86, 334, 388, 604, 736, 790, 1454, 1578, 1660, 1844, 2030, 2114, and/or 2156.

The present invention also provides compositions comprising at least one recombinant tyrosine ammonia lyase provided herein. In some embodiments, the compositions comprise one recombinant tyrosine ammonia lyase provided herein.

The present invention also provides recombinant polynucleotide sequences encoding at least one recombinant tyrosine ammonia lyase provided herein. In some embodiment, a recombinant polynucleotide sequence encodes one recombinant tyrosine ammonia lyase. In some embodiments, the polynucleotide sequence is codon-optimized. In some additional embodiments, the polynucleotide comprises at least 90% sequence identity to at least one of the odd-numbered sequences of SEQ ID NOS: 9-2289. In yet some further embodiments, the recombinant polynucleotide sequence comprises an odd-numbered sequence of SEQ ID NOS: 9-2289.

The present invention also provides expression vectors comprising at least one recombinant polynucleotide sequence encoding a recombinant tyrosine ammonia lyase provided herein. In some embodiments, the expression vectors comprises a recombinant polynucleotide sequence encoding a recombinant tyrosine ammonia lyase provided herein. In some embodiments of the expression vectors, the recombinant polynucleotide sequence is operably linked to a control sequence. In some additional embodiments of the expression vectors, the control sequence comprises a promoter. In some additional embodiments of the expression vectors, the control sequence is a promoter. In some embodiments of the expression vectors, the promoter is a heterologous promoter.

The present invention also provides host cells comprising at least one expression vector provided herein. In some embodiments, the host cell comprises one expression vector provided herein, while in some alternative embodiments, the host cell comprises two or more expression vectors provided herein. In some embodiments, the host cell is prokaryotic, while in some alternative embodiments, the host cell is eukaryotic.

The present invention also provides methods of producing a recombinant tyrosine ammonia lyase, comprising culturing at least one host cell provided herein, under conditions that the tyrosine ammonia lyase encoded by the recombinant polynucleotide is produced. In some embodiments, the methods further comprise the step of recovering the recombinant tyrosine ammonia lyase. In some additional embodiments, the methods further comprise the step of purifying the recombinant tyrosine ammonia lyase.

The present invention also provides pharmaceutical compositions for the treatment of tyrosinemia comprising at least one recombinant tyrosine ammonia lyase provided herein. In some embodiments, the pharmaceutical composition further comprises a pharmaceutically acceptable carrier and/or excipient. In some additional embodiments, the pharmaceutical composition is suitable for oral administration to a human. In some embodiments, the pharmaceutical composition is in the form of a pill, tablet, capsule, gelcap, liquid, or emulsion. In yet some further embodiments, the pharmaceutical composition is coadministered with nitisinone. In some additional embodiments, the pharmaceutical composition comprises nitisinone. In some embodiments, the pill, tablet, capsule, or gelcap further comprises an enteric coating. In some additional embodiments, the pharmaceutical composition is suitable for parenteral injection into a human. In yet some additional embodiments, the pharmaceutical composition is coadministered with a phenylalanine ammonia lyase. In some further embodiments, the pharmaceutical composition comprises phenylalanine ammonia lyase. In some embodiments, the pharmaceutical composition comprises a pill, tablet, capsule, or gelcap that further comprises an enteric coating. In yet some additional embodiments, the pharmaceutical composition is coadministered with both nitisinone and a phenylalanine ammonia lyase. In some further embodiments, the pharmaceutical composition comprises both nitisinone and phenylalanine ammonia lyase. In some embodiments, the pharmaceutical composition comprises a pill, tablet, capsule, or gelcap that further comprises an enteric coating.

The present invention also provides methods for treating and/or preventing the symptoms of tyrosinemia or alkaptonuria in a subject, comprising providing a subject having tyrosinemia or alkaptonuria, and providing at least one pharmaceutical composition provided herein to the subject. In some embodiments, the methods comprise administering more than one composition or pharmaceutical composition provided herein are administered to the subject. In some alternative embodiments, only one composition or pharmaceutical composition is administered to the subject. In some embodiments, the symptoms of tyrosinemia or alkaptonuria are ameliorated. In yet some further embodiments, the subject is able to eat a diet that is less restricted in its phenylalanine, methionine, and/or tyrosine content than diets required by subjects exhibiting the symptoms of tyrosinemia or alkaptonuria. In some embodiments, the subject is an infant or child, while in some alternative embodiments, the subject is an adult or young adult.

The present invention also provides methods for the production of L-tyrosine and/or L-tyrosine derivatives comprising the steps of providing at least one recombinant tyrosine ammonia lyase(s) provided herein and a suitable substrate, and combining the recombinant tyrosine ammonia lyase(s) and the substrate under conditions such that L-tyrosine and/or at least one L-tyrosine derivative is produced. In some embodiments, only one recombinant tyrosine ammonia lyase is utilized in the methods, while in some alternative embodiments, at least two recombinant tyrosine ammonia lyases are utilized.

The present invention also provides methods for the production of coumaric acid, comprising the steps of providing at least one recombinant tyrosine ammonia lyase, and a suitable substrate, and combining the recombinant tyrosine ammonia lyase(s) and the substrate under conditions such that coumaric acid is produced. In some embodiments, only one recombinant tyrosine ammonia lyase is utilized in the methods, while in some alternative embodiments, at least two recombinant tyrosine ammonia lyases are utilized.

The present invention also provides use of the compositions and pharmaceutical compositions provided herein.

DESCRIPTION OF THE INVENTION

The present invention provides engineered tyrosine ammonia-lyase (TAL) polypeptides and compositions thereof. In some embodiments, the engineered TAL polypeptides have been optimized to provide enhanced catalytic activity and enhanced acid stability, while reducing sensitivity to proteolysis. The invention also provides methods for utilization of the compositions comprising the engineered TAL polypeptides for therapeutic and industrial purposes.

Abbreviations and Definitions:

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

Also, as used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value. In some instances, "about" encompasses values that are within 2.5%, 3%, 3.5%, 4%, 4.5%, 5%, 5.5%, 6%, 6.5%, 7%, 7.5%, 8%, 8.5%, 9%, 9.5%, or 10% of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

As used herein, the terms "tyrosine ammonia-lyase" "tyrosine ammonia lyase," "tyrosine ammonia lyase polypeptide" and "TAL" refer to a class of enzymes within the aromatic amino acid lyase family (EC 4.3.1.23, EC 4.3.1.24 and EC4.3.1.25) which also includes histidine ammonia-lyase, and phenylalanine ammonia-lyase.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes. "Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes. The abbreviations used for the genetically encoded amino acids are conventional and are as follows: alanine (Ala or A), arginine (Arg or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V). When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

"Deimmunized" as used herein, refers to the manipulation of a protein to create a variant that is not as immunogenic as the wild-type or reference protein. In some embodiments, the deimmunization is complete, in that the variant protein does not stimulate an immune response in patients to whom the variant protein is administered. This response can be measured by various methods including but not limited to, the presence or abundance of anti-drug antibodies, the presence or abundance of neutralizing antibodies, the presence of an anaphylactic response, or the prevalence or intensity of cytokine release upon administration of the protein. In some embodiments, the variant protein is less immunogenic than the wild-type or reference protein. In some embodiments, deimmunization involves modifications to proteins (e.g., epitopes) that are recognized by T-cell receptors. In some embodiments, the T-cell epitopes are removed from a wild-type or reference protein in order to produce a deimmunized variant protein. In some embodiments, the deimmunized protein shows lower levels of response in biochemical and cell-biological predictors of human immunological responses including dendritic-cell T-cell activation assays, or human leukocyte antigen (HLA) peptide binding assays.

"Coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., 1977, Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered TAL, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X93 as compared to SEQ ID NO: 2" refers to a difference of the amino acid residue at the polypeptide position corresponding to position 93 of SEQ ID NO: 2. Thus, if the reference polypeptide of SEQ ID NO: 2 has a leucine at position 93, then a "residue difference at position X93 as compared to SEQ ID NO: 2" has an amino acid substitution of any residue other than leucine at the position of the polypeptide corresponding to position 93 of SEQ ID NO: 2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances, the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The present application includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered transaminase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" or a "biologically active fragment" used interchangeably herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered TAL of the present invention) and that retains substantially all of the activity of the full-length polypeptide.

"Isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant TAL polypeptides may be present within a cell, present in the cellular medium, or prepared in various forms, such as lysates or isolated preparations. As such, in some embodiments, the recombinant TAL polypeptides can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure TAL composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant TAL polypeptides are substantially pure polypeptide compositions.

"Improved enzyme property" refers to an engineered TAL polypeptide that exhibits an improvement in any enzyme property as compared to a reference TAL polypeptide and/or as a wild-type PAL polypeptide (e.g., the wild-type sequence of SEQ ID NO: 2) or another engineered TAL polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, reduced immunogenicity, and altered temperature profile.

"Increased enzymatic activity" or "enhanced catalytic activity" refers to an improved property of the engineered TAL polypeptides, which can be represented by an increase in specific activity (e.g., product produced/time/weight protein) or an increase in percent conversion of the substrate to the product (e.g., percent conversion of starting amount of substrate to product in a specified time period using a specified amount of TAL) as compared to the reference TAL enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring TAL or another engineered TAL from which the TAL polypeptides were derived.

In some embodiments, the engineered TAL polypeptides have a $k_{cat}$ of at least 0.1/sec, at least 0.2/sec, at least 0.3/sec, at least 0.5/sec, at least 1.0/sec and in some preferred embodiments greater than 1.0/sec. In some embodiments, the $K_m$ is in the range of about 1 µm to about 5 mM; in the range of about 5 µm to about 2 mM; in the range of about 10 µm to about 2 mM; or in the range of about 10 µm to about 1 mM. In some specific embodiments, the engineered TAL enzyme exhibits improved enzymatic activity in the range of 1.5 to 10 fold, 1.5 to 25 fold, 1.5 to 50 fold, 1.5 to 100 fold or greater than that of a reference TAL enzyme (e.g., a wild-type TAL or any other reference TAL). TAL activity can be measured by any suitable method known in the art (e.g., standard assays, such as monitoring changes in spectrophotometric properties of reactants or products). In some embodiments, the amount of products produced can be measured by High-Performance Liquid Chromatography (HPLC) separation combined with UV absorbance or fluorescent detection directly or following o-phthaldialdehyde (OPA) derivatization. In some embodiments, other methods are used, such as tracking the coumarate product (e.g., use UV absorbance to track its production at 290 nm or 310 nm). In some other embodiments, the production of ammonia is assayed using commercially available kits (e.g., the Megazyme rapid ammonia assay kit [Megazyme International, Wicklow, Ireland]). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

The terms "thermally stable" and "thermostable" refer to enzymes of the present invention that retain a specified amount of enzymatic activity, primary, secondary, tertiary and quaternary structure after exposure to identified temperatures over a given period of time under conditions prevailing during the use of the enzyme, for example, when exposed to altered temperatures. "Altered temperatures" include increased or decreased temperatures. In some embodiments, the enzymes retain at least about 50%, about 60%, about 70%, about 75%, about 80%, about 85%, about 90%, about 92%, about 95%, about 96%, about 97%, about 98%, or about 99% enzymatic activity after exposure to altered temperatures over a given time period, for example, at least about 60 minutes, about 120 minutes, about 180 minutes, about 240 minutes, about 300 minutes, etc.

The term "improved tolerance to acidic pH" means that a recombinant TAL according to the invention will have increased stability (higher retained activity at about pH 7.0 after exposure to acidic pH for a specified period of time (1 hour, up to 24 hours)) as compared to a reference TAL or another enzyme.

"Physiological pH" as used herein means the pH range generally found in a subject's (e.g., human) small intestine. There normally is a pH gradient from the pyloric sphincter to the large intestine from about 5.0 to 7.5.

The term "acidic pH" (e.g., used with reference to improved stability to acidic pH conditions or increased tolerance to acidic pH) means a pH range of about 1.5 to 6.8.

The terms "proteolytic activity" and "proteolysis" used interchangeably herein refer to the breakdown of proteins into smaller polypeptides or amino acids. The breakdown of proteins is generally the result of hydrolysis of the peptide bond by protease (proteinase) enzymes. Protease enzymes include but are not limited to pepsin, trypsin, chymotrypsin, elastase, carboxypeptidase A and B, peptidases (e.g., amino peptidase, dipeptidase and enteropeptidase).

The phrases "reducing sensitivity to proteolysis" and "reducing proteolytic sensitivity" used interchangeably herein mean that an engineered TAL polypeptide according to the invention will have a higher enzyme activity compared to a reference TAL and/or another enzyme in a standard assay after treatment with one or more proteases. Exemplary assays are provided in the Examples.

"Aggregation" means clumping or precipitation of a TAL polypeptide. Aggregation can lead to inactivation, and/or increased immunogenicity of the enzyme. The term "reduced aggregation" means an engineered TAL polypeptide will be less prone to aggregation or to aggregate than a reference TAL and/or another enzyme. Methods for determining Aggregation can be determined by one of general skill in the art by using any number of assays including but not limited to fluorescent microscopy with appropriate dyes (e.g., thioflavin T or Nile Red), dynamic light scattering, flow cytometry with appropriate dyes (e.g. Bodipy), filtration and analysis by SDS-PAGE or Western blotting, fluorescent correlation spectroscopy, and electron microscopy. There are commercially available kits to assess aggregation (e.g., the PROTEOSTAT® Protein Aggregation Assay kit [Enzo]).

"Conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a TAL polypeptide can be expressed as "percent conversion" of the substrate to the product in a specific period of time.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the TAL enzymes may be codon optimized for optimal production from the host organism selected for expression.

"Control sequence" refers herein to include all components, which are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refers to those conditions in the enzymatic conversion reaction solution (e.g., ranges of enzyme loading, substrate loading, temperature, pH, buffers, co-solvents, etc.) under which a TAL polypeptide of the present application is capable of converting a substrate to the desired product compound, Exemplary "suitable reaction conditions" are provided in the present application and illustrated by the Examples. "Loading", such as in "compound loading" or "enzyme loading" refers to the concentration or amount of a component in a reaction mixture at the start of the reaction. "Substrate" in the context of an enzymatic conversion reaction process refers to the compound or molecule acted on by the TAL polypeptide. "Product" in the context of an enzymatic conversion process refers to the compound or molecule resulting from the action of the TAL polypeptide on a substrate.

As used herein the term "culturing" refers to the growing of a population of microbial cells under any suitable conditions (e.g., using a liquid, gel or solid medium).

Recombinant polypeptides can be produced using any suitable methods known the art. Genes encoding the wild-type polypeptide of interest can be cloned in vectors, such as plasmids, and expressed in desired hosts, such as E. coli, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant TAL polypeptides" (also referred to herein as "engineered TAL polypeptides," "variant TAL enzymes," and "TAL variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the TAL variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered TAL polypeptide encompassed by the invention and an acceptable carrier.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the 28$^{th}$ day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered TAL of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of tyrosinemia or alkaptonuria).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered TAL polypeptides of the present invention). Excipients are typically included for formulation and/or administration purposes.

The term "therapeutically effective amount" when used in reference to symptoms of disease/condition refers to the amount and/or concentration of a compound (e.g., engineered TAL polypeptides) that ameliorates, attenuates, or eliminates one or more symptom of a disease/condition or prevents or delays the onset of symptom(s).

The term "therapeutically effective amount" when used in reference to a disease/condition refers to the amount and/or concentration of a composition (e.g., engineered TAL polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

It is intended that the terms "treating," "treat" and "treatment" encompass preventative (e.g., prophylactic), as well as palliative treatment.

Engineered TAL Polypeptides:

The parent enzyme used to generate the engineered TAL polypeptides is selected from enzymes obtained from *Stanieria cyanosphera* (SEQ ID NO: 2), *Chroogloeocystis siderophila* (SEQ ID NO: 4), *Flavobacterium johnsoniae* (SEQ ID NO: 6), and *Rhodotorula glutinis* (SEQ ID NO: 8). In some embodiments, the engineered TAL polypeptides are derived by directed evolution from *S. cyanosphera*. Furthermore, when a particular TAL variant (engineered TAL polypeptide) is referred to by reference to modification of particular amino acids residues in the sequence of a wild-type TAL, wild-type PAL, wild-type HAL or another TAL, it is to be understood that variants of another TAL modified in the equivalent position(s) (as determined from the optional amino acid sequence alignment between the respective amino acid sequences) are encompassed herein. In some embodiments the engineered TAL polypeptide will comprise the conserved active site Ala164-Ser165-Gly166 and comprise at least 70% (at least 75%, at least 80%, at least 85%, at least 90%, at least 93%, at least 95%, at least 97%) sequence identity to SEQ ID NO: 2. In some embodiments the engineered TAL polypeptides comprise not only TAL activity but also may be active on phenylalanine and/or histidine substrates. In some embodiments, TAL variants are developed that comprise at least one mutation in at least one key residue (See e.g., WO 2008/069958; US Appln. Ser. No. 2009/011140; and Watts et al. Chem. Biol., 13:1317-26 [2006]).

In some embodiments, engineered TAL polypeptides are produced by cultivating a microorganism comprising at least one polynucleotide sequence encoding at least one engineered TAL polypeptide under conditions which are conducive for producing the engineered TAL polypeptide(s). In some embodiments, the engineered TAL polypeptide is recovered from the resulting culture medium and/or cells.

The present invention provides exemplary engineered TAL polypeptides having TAL activity. The Examples provide Tables showing sequence structural information correlating specific amino acid sequence features with the functional activity of the engineered TAL polypeptides. This structure-function correlation information is provided in the form of specific amino acid residues differences relative to a reference engineered polypeptide, as indicated in the Examples. The Examples further provide experimentally determined activity data for the exemplary engineered TAL polypeptides.

In some embodiments, the engineered TAL polypeptides of the invention having TAL activity comprise a) an amino acid sequence having at least about 85% sequence identity to reference sequence SEQ ID NO: 2, 14, 86, 334, 388, 604, 736, 790, 1454, 1578, 1660, 1844, 2030, 2114, and/or 2156; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 2, 14, 86, 334, 388, 604, 736, 790, 1454, 1578, 1660, 1844, 2030, 2114, and/or 2156, and/or another reference sequence.

In some embodiments the engineered TAL which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, 14, 86, 334, 388, 604, 736, 790, 1454, 1578, 1660, 1844, 2030, 2114, and/or 2156, and an amino acid residue difference as compared to SEQ ID NO: 2, 14, 86, 334, 388, 604, 736, 790, 1454, 1578, 1660, 1844, 2030, 2114, and/or 2156, at one or more amino acid positions (e.g., at 1, 2, 3, 4, 5, 6, 7, 8, 9, 10, 11, 12, 14, 15, 20 or more amino acid positions compared to SEQ ID NO:

2, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156). In some embodiment the residue difference as compared to SEQ ID NO: 2, 14, 86, 334, 388, 604, 736, 790, 1454, 1578, 1660, 1844, 2030, 2114, and/or 2156, at one or more positions will include at least 1, 2, 3, 4, 5, 6, 7, 8, 9, 10 or more conservative amino acid substitutions. In some embodiments the engineered TAL which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO: 2, 14, 86, 334, 388, 604, 736, 790, 1454, 1578, 1660, 1844, 2030, 2114, and/or 2156.

In some embodiments, the engineered TAL polypeptides of the invention having TAL activity comprise a) an amino acid sequence having at least 85% sequence identity to reference sequence SEQ ID NO: 2, 14, 86, 334, 388, 604, 736, 790, 1454, 1578, 1660, 1844, 2030, 2114, and/or 2156; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits an improved property selected from i) enhanced catalytic activity, ii) reduced proteolytic sensitivity, iii) increased tolerance to acidic pH, iv) reduced aggregation or a combination of any of i), ii), iii) or iv), as compared to SEQ ID NO: 2, 14, 86, 334, 388, 604, 736, 790, 1454, 1578, 1660, 1844, 2030, 2114, and/or 2156, and/or another reference sequence.

In some embodiments, the engineered TAL polypeptide is a polypeptide listed in Table 1-1, 2-1, 3-1, 4-1, 5-1, 6-1, 7-1, 8-1, 9-1, 9-2, 10-1, 10-2, 11-1, 12-1, 13-1, 14-1, 15-1, 16-1, and/or 17-1.

In some embodiments, the engineered TAL polypeptide comprises a functional fragment of an engineered TAL polypeptide encompassed by the invention. Functional fragments have at least 95%, 96%, 97%, 98%, or 99% of the activity of the engineered TAL polypeptide from which is was derived (i.e., the parent engineered TAL). A functional fragment comprises at least 90%, 91%, 92%, 93%, 94%, 95%, 96%, 97%, 98% and even 99% of the parent sequence of the engineered TAL. In some embodiments the functional fragment is truncated by less than 5, less than 10, less than 15, less than 10, less than 25, less than 30, less than 35, less than 40, less than 45, and less than 50 amino acids.

Variants with Reduced Sensitivity to Proteolysis:

In some embodiments, the engineered TAL polypeptides of the invention having TAL activity comprise a) an amino acid sequence having at least 85% sequence identity to reference sequence SEQ ID NO: 2, 14, 86, 334, 388, 604, 736, 790, 1454, 1578, 1660, 1844, 2030, 2114, and/or 2156; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits reduced sensitivity to proteolysis as compared to SEQ ID NO: 2, 14, 86, 334, 388, 604, 736, 790, 1454, 1578, 1660, 1844, 2030, 2114, and/or 2156, and/or another reference sequence.

In some embodiments the engineered TAL which exhibits reduced sensitivity to proteolysis has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156, and an amino acid residue difference as compared to SEQ ID NO: 2, 14, 86, 334, 388, 604, 736, 790, 1454, 1578, 1660, 1844, 2030, 2114, and/or 2156, at one or more amino acid positions (e.g., at 1, 2, 3, 4, 5, 6, 7, 8, 9, 10, 11, 12, 14, 15, 20 or more amino acid positions compared to SEQ ID NO: 2, 14, 86, 334, 388, 604, 736, 790, 1454, 1578, 1660, 1844, 2030, 2114, and/or 2156, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156).

In some embodiments, the proteolytic sensitivity of the engineered TAL polypeptide will be reduced by at least 5%, at least 10%, at least 15%, at least 20%, at least 25%, at least 30%, at least 40%, at least 50%, at least 60%, at least 70%, at least 80% and at least 85% compared to the wild-type *Stanieria cyanosphaera* enzyme of SEQ ID NO:2, and/or at least one reference TAL polypeptide under essentially the same conditions. The proteolytic sensitivity can be measured using any suitable assay system, including, but not limited to the assays described in the Examples.

In some embodiments, the engineered TAL polypeptide having reduced sensitivity to proteolysis has reduced sensitivity to a composition comprising one or more proteases such as but not limited to pepsin, trypsin, chymotrypsin, carboxypeptidase A and B, peptidases (e.g., amino peptidase, dipeptidase and enteropeptidase) when both the reference TAL and the engineered TAL having the reduced sensitivity are compared and exposed to essentially the same amount and kind of protease under essentially the same conditions.

In some embodiments, the engineered TAL polypeptide having reduced sensitivity to proteolysis has enzyme activity that is about 1.0 fold, 2-fold, 5-fold, 10-fold, 20-fold, 25-fold, 50-fold, 75-fold, 100-fold, 150-fold, 200-fold or more of the enzymatic activity of the reference TAL. In some embodiments, the engineered polypeptides will have more enzyme activity (as compared to a reference TAL) when activity is measured at a pH range of 4.5 to 7.5; when activity is measured at a pH range of 4.5 to 6.5; when activity is measured at a pH range of 5.0 to 7.5; when activity is measured at a pH range of 5.0 to 6.5; when activity is measured at a pH range of 5.5 to 7.5 and also when activity is measured at a pH range of 5.5 to 6.5. In other embodiments, the engineered TAL polypeptides will have a $K_m$ in the range of 1 μM to 5 mM.

Variants with Increased Tolerance to Acidic pH:

In some embodiments, the engineered TAL polypeptides of the invention having TAL activity comprise a) an amino acid sequence having at least 85% sequence identity to reference sequence SEQ ID NO: 2, 14, 86, 334, 388, 604, 736, 790, 1454, 1578, 1660, 1844, 2030, 2114, and/or 2156, or a fragment thereof; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits increased tolerance to acidic pH as compared to SEQ ID NO: 2, 14, 86, 334, 388, 604, 736, 790, 1454, 1578, 1660, 1844, 2030, 2114, and/or 2156, and/or another reference sequence.

In some embodiments, the engineered TAL that exhibits increased tolerance to acidic pH has at least about 85%, at least about 88%, at least about 90%, at least about 91%, at least about 92%, at least about 93%, at least about 94%, at least about 95%, at least about 96%, at least about 97%, at least about 98%, at least about 99%, or greater amino acid sequence identity with SEQ ID NO: 2, 14, 86, 334, 388, 604, 736, 790, 1454, 1578, 1660, 1844, 2030, 2114, and/or 2156, and an amino acid residue difference as compared to SEQ ID NO: 2, 14, 86, 334, 388, 604, 736, 790, 1454, 1578, 1660, 1844, 2030, 2114, and/or 2156, at one or more amino acid positions (e.g., at 1, 2, 3, 4, 5, 6, 7, 8, 9, 10, 11, 12, 14, 15, 20 or more amino acid positions compared to SEQ ID NO: 2, 14, 86, 334, 388, 604, 736, 790, 1454, 1578, 1660, 1844, 2030, 2114, and/or 2156, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156.

In some embodiments, the engineered TAL polypeptides of the invention having TAL activity comprise a) an amino acid sequence having at least 85% sequence identity to reference sequence SEQ ID NO: 2, 14, 86, 334, 388, 604, 736, 790, 1454, 1578, 1660, 1844, 2030, 2114, and/or 2156, or a fragment thereof; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits increased tolerance to acidic pH as compared to SEQ ID NO: 2, 14, 86, 334, 388, 604, 736, 790, 1454, 1578, 1660, 1844, 2030, 2114, and/or 2156, and/or another reference sequence.

In some embodiments, the engineered TAL that exhibits increased tolerance to acidic pH has at least 85%, at least 88%, at least 90%, at least 91%, at least 92%, at least 93%, at least 94%, at least 95%, at least 96%, at least 97%, at least 98%, at least 99%, or greater amino acid sequence identity with SEQ ID NO: 2, 14, 86, 334, 388, 604, 736, 790, 1454, 1578, 1660, 1844, 2030, 2114, and/or 2156, and an amino acid residue difference as compared to SEQ ID NO: 2, 14, 86, 334, 388, 604, 736, 790, 1454, 1578, 1660, 1844, 2030, 2114, and/or 2156, at one or more amino acid positions (e.g., at 1, 2, 3, 4, 5, 6, 7, 8, 9, 10, 11, 12, 14, 15, 20 or more amino acid positions compared to SEQ ID NO: 2, 14, 86, 334, 388, 604, 736, 790, 1454, 1578, 1660, 1844, 2030, 2114, and/or 2156, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156.

In some embodiments, when all other assay conditions are essentially the same, the engineered TAL polypeptide has increased tolerance to acidic pH as compared to a reference TAL polypeptide. The engineered peptide has an increased tolerance at a pH range between 1.5 to 6.5, and between 1.5 and 5.0, and between 2.0 to 5.5, and between 3.0 and 6.8; between 3.0 and 5.5; between 4.0 and 6.5; between 4.0 and 4.5; between 4.5 and between 5.0; between 4.5 and 5.5, between 4.5 and 6.0; between 4.5 and 6.5; between 5.0 and 6.5; between 5.0 and 6.0; between 5.0 and 5.5; between 5.5 and 6.0; between 6.0 and 6.5 and between 6.5 and 7.0. In some embodiments the increased tolerance to acidic pH will be exhibited at a pH of about 3.5, 4.0, 4.5, 5.0, 5.5, 6.0 and 6.5.

In some embodiments, the engineered TAL polypeptide having increased tolerance to acidic pH exhibits greater TAL activity as compared to a reference TAL when measured by any standard assay, including, but not limited to the assays described in the Examples.

Variants with Improved Activity:

In some embodiments, the engineered TAL polypeptides of the invention having TAL activity comprise a) an amino acid sequence having at least 85% sequence identity to reference sequence SEQ ID NO: 2, 14, 86, 334, 388, 604, 736, 790, 1454, 1578, 1660, 1844, 2030, 2114, and/or 2156, or a fragment thereof; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits improved activity, as compared to SEQ ID NO: 2, 14, 86, 334, 388, 604, 736, 790, 1454, 1578, 1660, 1844, 2030, 2114, and/or 2156, and/or another reference sequence.

In some embodiments, the engineered TAL that exhibits improved activity has at least about 85%, at least about 88%, at least about 90%, at least about 91%, at least about 92%, at least about 93%, at least about 94%, at least about 95%, at least about 96%, at least about 97%, at least about 98%, at least about 99%, or greater amino acid sequence identity with SEQ ID NO: 2, 14, 86, 334, 388, 604, 736, 790, 1454, 1578, 1660, 1844, 2030, 2114, and/or 2156, and an amino acid residue difference as compared to SEQ ID NO: 2, 14, 86, 334, 388, 604, 736, 790, 1454, 1578, 1660, 1844, 2030, 2114, and/or 2156, at one or more amino acid positions (e.g., at 1, 2, 3, 4, 5, 6, 7, 8, 9, 10, 11, 12, 14, 15, 20 or more amino acid positions compared to SEQ ID NO: 2, 14, 86, 334, 388, 604, 736, 790, 1454, 1578, 1660, 1844, 2030, 2114, and/or 2156, or a sequence having at least about 85%, at least about 88%, at least about 90%, at least about 91%, at least about 92%, at least about 93%, at least about 94%, at least about 95%, at least about 96%, at least about 97%, at least about 98%, at least about 99%, or greater amino acid sequence identity with SEQ ID NO: 2, 14, 86, 334, 388, 604, 736, 790, 1454, 1578, 1660, 1844, 2030, 2114, and/or 2156.

In some embodiments, the engineered TAL polypeptides of the invention having TAL activity comprise a) an amino acid sequence having at least 85% sequence identity to reference sequence SEQ ID NO: 2, 14, 86, 334, 388, 604, 736, 790, 1454, 1578, 1660, 1844, 2030, 2114, and/or 2156, or a fragment thereof; b) an amino acid residue difference as compared to SEQ ID NO: 2, 14, 86, 334, 388, 604, 736, 790, 1454, 1578, 1660, 1844, 2030, 2114, and/or 2156, at one or more amino acid positions; and c) which exhibits improved activity, as compared to SEQ ID NO: 2, 14, 86, 334, 388, 604, 736, 790, 1454, 1578, 1660, 1844, 2030, 2114, and/or 2156, and/or another reference sequence.

In some embodiments, the engineered TAL that exhibits improved activity has at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156, and an amino acid residue difference as compared to SEQ ID NO: 2, 14, 86, 334, 388, 604, 736, 790, 1454, 1578, 1660, 1844, 2030, 2114, and/or 2156, at one or more amino acid positions (e.g., at 1, 2, 3, 4, 5, 6, 7, 8, 9, 10, 11, 12, 14, 15, 20 or more amino acid positions compared to SEQ ID NO: 2, 14, 86, 334, 388, 604, 736, 790, 1454, 1578, 1660, 1844, 2030, 2114, and/or 2156, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 14, 86, 334, 388, 604, 736, 790, 1454, 1578, 1660, 1844, 2030, 2114, and/or 2156.

In some embodiments, when all other assay conditions are essentially the same, the engineered TAL polypeptide has improved activity as compared to a reference TAL polypeptide. In some embodiments this activity can be measured under conditions that monitor enzymatic activity at saturating levels of tyrosine, thus assessing the maximum activity of the enzyme ($k_{cat}$). In other embodiments this activity can be measured under substrate concentrations resulting in one-half, one-fifth, one-tenth or less of maximal activity. Under either method of analysis, the engineered polypeptide has improved activity levels about 1.0 fold, 1.5-fold, 2-fold, 5-fold, 10-fold, 20-fold, 25-fold, 50-fold, 75-fold, 100-fold, or more of the enzymatic activity of the reference TAL In some embodiments, the engineered TAL polypeptide having improved activity as compared to a reference TAL when measured by any standard assay, including, but not limited to the assays described in the Examples.

In light of the guidance provided herein, it is further contemplated that any of the exemplary engineered polypeptides (e.g., SEQ ID NOS: 10-2290; in particular SEQ ID NOS: 2, 14, 86, 334, 388, 604, 736, 790, 1454, 1578, 1660, 1844, 2030, 2114, and/or 2156) can be used as the starting amino acid sequence for synthesizing other engineered TAL polypeptides, for example by subsequent rounds of evolution by adding new combinations of various amino acid differences from other polypeptides and other residue positions described herein. Further improvements may be generated by including amino acid differences at residue positions that had been maintained as unchanged throughout earlier rounds of evolution.

Polynucleotides Encoding Engineered Polypeptides, Expression Vectors and Host Cells:

The present invention provides polynucleotides encoding the engineered TAL polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered TAL polypeptides can be introduced into appropriate host cells to express the corresponding TAL polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered TAL polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Table 1-1, 2-1, 3-1, 4-1, 5-1, 6-1, 7-1, 8-1, 9-1, 9-2, 10-1, 10-2, 11-1, 12-1, 13-1, 14-1, 15-1, 16-1, and/or 17-1, as well as SEQ ID NOS: 2, 14, 86, 334, 388, 604, 736, 790, 1454, 1578, 1660, 1844, 2030, 2114, and/or 2156.

In various embodiments, the codons are preferably selected to fit the host cell in which the protein is being produced. For example, preferred codons used in bacteria are used for expression in bacteria. Consequently, codon optimized polynucleotides encoding the engineered TAL polypeptides contain preferred codons at about 40%, 50%, 60%, 70%, 80%, or greater than 90% of codon positions of the full length coding region.

In some embodiments, as described above, the polynucleotide encodes an engineered polypeptide having TAL activity with the properties disclosed herein, wherein the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NOS: 2, 14, 86, 334, 388, 604, 736, 790, 1454, 1578, 1660, 1844, 2030, 2114, and/or 2156, or the amino acid sequence of any variant as disclosed in Tables 1-1, 2-1, 3-1, 4-1, 5-1, 6-1, 7-1, 8-1, 9-1, 9-2, 10-1, 10-2, 11-1, 12-1, 13-1, 14-1, 15-1, 16-1, and/or 17-1, and one or more residue differences as compared to the reference polypeptide of SEQ ID NOS: 2, 14, 86, 334, 388, 604, 736, 790, 1454, 1578, 1660, 1844, 2030, 2114, and/or 2156, or the amino acid sequence of any variant as disclosed in Table 1-1, 2-1, 3-1, 4-1, 5-1, 6-1, 7-1, 8-1, 9-1, 9-2, 10-1, 10-2, 11-1, 12-1, 13-1, 14-1, 15-1, 16-1, and/or 17-1 (e.g., 1, 2, 3, 4, 5, 6, 7, 8, 9, 10 or more amino acid residue positions). In some embodiments, the reference sequence is selected from SEQ ID NOS: 2, 14, 86, 334, 388, 604, 736, 790, 1454, 1578, 1660, 1844, 2030, 2114, and/or 2156.

In some embodiments, the polynucleotide encoding the engineered TAL polypeptides comprises a polynucleotide sequence selected from a polynucleotide sequence encoding the SEQ ID NOS: 3, 13, 85, 333, 387, 603, 735, 789, 1453, 1577, 1659, 1843, 2029, 2113, and/or 2155. In some embodiments, the polynucleotide encoding an engineered TAL polypeptide has at least 80%, 85%, 90%, 93%, 95%, 96%, 97%, 98%, 99% nucleotide residue identity to SEQ ID NOS: 3, 13, 85, 333, 387, 603, 735, 789, 1453, 1577, 1659, 1843, 2029, 2113, and/or 2155. In some embodiments, the polynucleotides are capable of hybridizing under highly stringent conditions to a reference polynucleotide sequence selected from SEQ ID NOS: 3, 13, 85, 333, 387, 603, 735, 789, 1453, 1577, 1659, 1843, 2029, 2113, and/or 2155, or a complement thereof, or a polynucleotide sequence encoding any of the variant TAL polypeptides provided herein.

In some embodiments, an isolated polynucleotide encoding any of the engineered TAL polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered TAL polypeptides provided herein. Effective signal peptide coding regions for bacterial host cells include, but are not limited to the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention also provides a recombinant expression vector comprising a polynucleotide encoding an engineered TAL polypeptide, and one or more expression regulating regions such as a promoter and a terminator, a replication origin, etc., depending on the type of hosts into which they are to be introduced. In some embodiments, the various nucleic acid and control sequences described above are joined together to produce a recombinant expression vector which includes one or more convenient restriction sites to allow for insertion or substitution of the nucleic acid sequence encoding the variant TAL polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant TAL polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered TAL polypeptide of the present application, the polynucleotide being operatively linked to one or more control sequences for expression of the engineered TAL enzyme(s) in the host cell. Host cells for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* and *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells are *Escherichia coli* strains (such as W3110 (ΔfhuA) and BL21).

Accordingly, in another aspect, the present invention provides methods for producing the engineered TAL polypeptides, where the methods comprise culturing a host cell capable of expressing a polynucleotide encoding the engineered TAL polypeptide under conditions suitable for expression of the polypeptide. In some embodiments, the methods further comprise the steps of isolating and/or purifying the TAL polypeptides, as described herein.

Appropriate culture media and growth conditions for the above-described host cells are well known in the art. Polynucleotides for expression of the TAL polypeptides may be introduced into cells by various methods known in the art. Techniques include, among others, electroporation, biolistic particle bombardment, liposome mediated transfection, calcium chloride transfection, and protoplast fusion.

The engineered TAL with the properties disclosed herein can be obtained by subjecting the polynucleotide encoding the naturally occurring or engineered TAL polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,684,771, 9,665,694; and WO 95/22625; WO 97/0078; WO 97/35966; WO 98/27230; WO 00/42651; WO 01/75767; WO 2009/152336, WO 2013/138339, WO 2015/048572, and WO 2015/048573; and all related US and non-US counterparts of these listed patents and applications; Ling et al., Anal. Biochem., 254:157-78 [1997]; Dale et al., Meth. Mol. Biol., 57:369-74 [1996]; Smith, Ann. Rev. Genet., 19:423-462 [1985]; Botstein et al., Science, 229: 1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; and Stemmer, Proc. Nat. Acad. Sci. USA, 91:10747-10751 [1994]; all of which are incorporated herein by reference).

In some embodiments, the enzyme clones obtained following mutagenesis treatment are screened by subjecting the enzymes to a defined temperature (or other assay conditions) and measuring the amount of enzyme activity remaining after heat treatments or other assay conditions. Clones containing a polynucleotide encoding a TAL polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors.

Accordingly, in some embodiments, a method for preparing the engineered TAL polypeptide can comprise: (a) synthesizing a polynucleotide encoding a polypeptide comprising an amino acid sequence selected from the amino acid sequence of any variant provided in Table 1-1, 2-1, 3-1, 4-1, 5-1, 6-1, 7-1, 8-1, 9-1, 9-2, 10-1, 10-2, 11-1, 12-1, 13-1, 14-1, 15-1, 16-1, and/or 17-1, as well as SEQ ID NOS: 2, 14, 86, 334, 388, 604, 736, 790, 1454, 1578, 1660, 1844, 2030, 2114, and/or 2156, and (b) expressing the TAL polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered TAL polypeptide can be measured for any desired improved property (e.g., activity, selectivity, stability, acid tolerance, protease sensitivity, etc.), using any suitable assay known in the art, including but not limited to the assays and conditions described herein.

In some embodiments, any of the engineered TAL polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the TAL polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant TAL enzymes. In some embodiments utilizing affinity chromatography purification, any antibody which specifically binds the variant TAL polypeptide finds use. For the production of antibodies, various host animals, including but not limited to rabbits, mice, rats, etc., are immunized by injection with a TAL polypeptide (e.g., a TAL variant), or a fragment thereof. In some embodiments, the TAL polypeptide or fragment is attached to a suitable carrier, such as BSA, by means of a side chain functional group or linkers attached to a side chain functional group.

In some embodiments, the engineered TAL polypeptide is produced in a host cell by a method comprising culturing a host cell (e.g., an *E. coli* strain) comprising a polynucleotide sequence encoding an engineered TAL polypeptide as described herein under conditions conducive to the production of the engineered TAL polypeptide and recovering the engineered TAL polypeptide from the cells and/or culture medium.

In some preferred embodiments, the invention encompasses a method of producing an engineered TAL polypeptide comprising culturing a recombinant bacterial cell comprising a polynucleotide sequence encoding an engineered TAL polypeptide having at least 85%, 90%, 95%, 96%, 97%, 98%, 99%, or 100% sequence identity to reference sequences SEQ ID NOS: 2, 14, 86, 334, 388, 604, 736, 790, 1454, 1578, 1660, 1844, 2030, 2114, and/or 2156, and one or more amino acid residue differences as compared to SEQ ID NO: 2, 14, 86, 334, 388, 604, 736, 790, 1454, 1578, 1660, 1844, 2030, 2114, and/or 2156, and/or combinations thereof when aligned, under suitable culture conditions to allow the production of the engineered TAL polypeptide and optionally recovering the engineered TAL polypeptide from the culture and/or cultured bacterial cells.

In some embodiments, once the engineered TAL polypeptides are recovered from the recombinant host cells or cell culture and they are further purified by any suitable method(s) known in the art. In some additional embodiments, the purified TAL polypeptides are combined with other ingredients and compounds to provide compositions and formulations comprising the engineered TAL polypeptide as appropriate for different applications and uses (e.g., pharmaceutical compositions).

Compositions:

Pharmaceutical Compositions

The present invention provides engineered TAL polypeptides suitable for use in pharmaceutical and other compositions, such as dietary/nutritional supplements.

Depending on the mode of administration, the compositions comprising a therapeutically effective amount of an engineered TAL according to the present invention are in the form of a solid, semi-solid, gel, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered TAL polypeptides are formulated for use in oral pharmaceutical compositions. Any suitable format for use in delivering the engineered TAL polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, suspensions (including but not limited to oil-based suspensions, oil-in water emulsions, etc.), slurries, syrups, controlled release formulations, suppositories, etc. In some embodiments, the engineered TAL polypeptides are provided in a format suitable for injection (i.e., in an injectable formulation). In some embodiments, the engineered TAL polypeptides are provided in biocompatible matrices such as sol-gels, including silica-based (e.g., oxysilane) sol-gels. In some embodiments, the engineered TAL polypeptides are encapsulated. In some alternative embodiments, the engineered TAL polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered TAL polypeptides be administered by any suitable means known in the art, including but not limited to parenteral, oral, topical, transdermal, intranasal, intraocular, intrathecal, via implants, etc.

In some embodiments, the engineered TAL polypeptides are chemically modified by glycosylation, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, 7,560,263, and 7,53,653; US Pat. Appln. Publ. Nos. 2013/0039898, 2012/0177722, etc.). Indeed, it is not intended that the present invention be limited to any particular delivery method and/or mechanism.

In some additional embodiments, the engineered TAL polypeptides are provided in formulations comprising matrix-stabilized enzyme crystals. In some embodiments, the formulation comprises a cross-linked crystalline engineered TAL enzyme and a polymer with a reactive moiety that adheres to the enzyme crystals. The present invention also provides engineered TAL polypeptides in polymers.

In some embodiments, compositions comprising the engineered TAL polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.). Additional components in oral formulations may include coloring and or sweetening agents (e.g., glucose, sucrose, and mannitol) and lubricating agents (e.g., magnesium stearate), as well as enteric coatings (e.g., methacrylate polymers, hydroxyl propyl methyl cellulose phthalate, and/or any other suitable enteric coating known in the art). In some embodiments, disintegrating or solubilizing agents are included (e.g., cross-linked polyvinyl pyrrolidone, agar, alginic acid or salts thereof, such as sodium alginate). In some embodiments, the engineered TAL polypeptide are be combined with various additional components, including but not limited to preservatives, suspending agents, thickening agents, wetting agents, alcohols, fatty acids, and/or emulsifiers, particularly in liquid formulations. In some embodiments, the engineered TAL polypeptides are administered to subjects in combination with other compounds used in the treatment of tyrosinemia and/or alkaptonuria, including but not limited to NTBC, nitisinone, antacids (e.g., omeprazole, esomeprazole and other prazoles), as well as any other suitable compounds. In some additional embodiments, the pharmaceutical composition is suitable for parenteral injection into a human. In yet some additional embodiments, the pharmaceutical composition is coadministered with a phenylalanine ammonia lyase. In some further embodiments, the pharmaceutical composition comprises phenylalanine ammonia lyase. In some embodiments, the pharmaceutical composition comprises a pill, tablet, capsule, or gelcap that further comprises an enteric coating. In yet some additional embodiments, the pharmaceutical composition is coadministered with both nitisinone and a phenylalanine ammonia lyase. In some further embodiments, the pharmaceutical composition comprises both nitisinone and phenylalanine ammonia lyase.

In some embodiments, the present invention provides engineered TAL polypeptides suitable for use in decreasing the concentration of tyrosine in fluids such as blood, cerebrospinal fluid, etc. The dosages of engineered TAL polypeptide(s) administered to an animal depend upon the condition or disease, the general condition of the animal, and other factors known to those in the art. In some embodiments, the compositions are intended for single or multiple administrations to an animal. In some embodiments, it is contemplated that the concentration of engineered TAL polypeptide(s) in the composition(s) administered to an animal (e.g., a human with tyrosinemia or alkaptonuria) is sufficient to effectively treat, ameliorate and/or prevent the symptoms of disease (e.g., tyrosinemia or alkaptonuria and/or tyrosinemia or alkaptonuria-related conditions, diseases and/or symptoms). In some embodiments, the engineered TAL polypeptides are administered in combination with other pharmaceutical and/or dietary compositions.

Industrial Compositions

It is contemplated that the engineered TAL polypeptides of the present invention will find use in industrial compositions. In some embodiments, the engineered TAL polypeptides find use in the production of chemicals (e.g., coumaric acid). In some embodiments, the engineered TAL polypeptides are formulated for use in the food and/or feed industries. In some embodiments, the engineered TAL polypeptides are formulated in granulated or pelleted products which are mixed with animal feed components such as additional enzymes (for example, cellulases, laccases, and amylases).

In some alternative embodiments, the engineered TAL polypeptides are used in liquid animal feed compositions (e.g., aqueous or oil based slurries). Thus, in some embodiments, the engineered TAL variants of the present invention are sufficiently thermotolerant and thermostable to withstand the treatment used to produce pellets and other processed feed/foods. In some further embodiments, the engineered TAL variants are used to produce tyrosine and/or tyrosine derivatives.

The engineered TAL polypeptides provided herein also find use in agricultural applications. Indeed, it is contemplated that modulation of TAL activity by using recombinant polypeptides having TAL activity will lead to effective herbicides.

The foregoing and other aspects of the invention may be better understood in connection with the following non-limiting examples. The examples are provided for illustrative purposes only and are not intended to limit the scope of the present invention in any way.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); E. coli W3110 (commonly used laboratory E. coli strain, available from the Coli Genetic Stock Center [CGSC], New Haven, Conn.); LB (Luria-Burtani); TB (terrific broth); HPLC (high pressure liquid chromatography); SDS-PAGE (sodium dodecyl sulfate polyacrylamide gel electrophoresis); PES (polyethersulfone); CFSE (carboxyfluorescein succinimidyl ester); IPTG (isopropyl β-D-1-thiogalactopyranoside); PMBS (polymyxin B sulfate); NADPH (nicotinamide adenine dinucleotide phosphate); FIOPC (fold improvements over positive control); PHE and Phe (phenylalanine); TYR and Tyr (tyrosine); PBMC (peripheral blood mononuclear cells); LB (Luria broth); MeOH (methanol); Athens Research (Athens Research Technology, Athens, Ga.); ProSpec (ProSpec Tany Technogene, East Brunswick, N.J.); Sigma-Aldrich (Sigma-Aldrich, St. Louis, Mo.); Ram Scientific (Ram Scientific, Inc., Yonkers, N.Y.); Pall Corp. (Pall, Corp., Pt. Washington, N.Y.); Millipore (Millipore, Corp., Billerica Mass.); Difco (Difco Laboratories, BD Diagnostic Systems, Detroit, Mich.); Molecular Devices (Molecular Devices, LLC, Sunnyvale, Calif.); Kuhner (Adolf Kuhner, AG, Basel, Switzerland); Microfluidics (Microfluidics Corp., Westwood, Mass.); Thermotron (Thermotron, Inc., Holland, Mich.); Cambridge Isotope Laboratories, (Cambridge Isotope Laboratories, Inc., Tewksbury, Mass.) Applied Biosystems (Applied Biosystems, part of Life Technologies, Corp., Grand Island, N.Y.); Greiner Bio-One (Greiner Bio-One North America, Monroe, N.C.); Agilent (Agilent Technologies, Inc., Santa Clara, Calif.); Thermo Scientific (part of Thermo Fisher Scientific, Waltham, Mass.); Corning (Corning, Inc., Palo Alto, Calif.); Megazyme (Megazyme International, Wicklow, Ireland); Enzo (Enzo Life Sciences, Inc., Farmingdale, N.Y.); GE Healthcare (GE Healthcare Bio-Sciences, Piscataway, N.J.); Pierce (Pierce Biotechnology (now part of Thermo Fisher Scientific), Rockford, Ill.); Phenomenex (Phenomenex, Inc., Torrance, Calif.); Optimal (Optimal Biotech Group, Belmont, Calif.); and Bio-Rad (Bio-Rad Laboratories, Hercules, Calif.).

Example 1

Synthesis and Assaying of TAL Enzymes with Tyrosine Ammonia Lyase (TAL) Activity In this Example, methods used in the synthesis and assaying of TAL enzymes for tyrosine ammonia lyase activity are described.

TAL Gene Acquisition and Construction of Expression Vectors

Polynucleotide sequences encoding phenylalanine and tyrosine ammonia lyases from *Stanieria cyanosphaera* (SEQ ID NO: 2), *Chroogloeocystis siderophila* (SEQ ID NO: 4), *Flavobacterium johnsoniae* (SEQ ID NO: 6), and *Rhodotorula glutinis* (SEQ ID NO: 8) were synthesized as the genes of SEQ ID NOS: 1, 3, 5, and 7, respectively. These synthetic genes were cloned into a pCK110900 vector system (See e.g., U.S. Pat. No. 7,629,157 and US Pat. Appln. Publn. Nos. 2016/0244787, and 2006/0195947, all of which are incorporated by reference), and subsequently expressed in an *E. coli* strain derived from W3110. In some embodiments, expression vectors lacking antimicrobial resistance markers find use.

High-Throughput (HTP) Growth of Cultures Expressing TAL Enzymes

Transformed *E. coli* cells were selected by plating onto LB agar plates containing 1% glucose and 30 µg/mL chloramphenicol. After overnight incubation at 37° C., colonies were picked onto NUNC™ (Thermo-Scientific) 96-well shallow flat bottom plates filled with 180 µL/well LB-medium supplemented with 1% glucose and 30 µg/mL chloramphenicol. Cultures were allowed to grow overnight for 18-20 hours in a shaker (200 rpm, 30° C., and 85% relative humidity; Kuhner). Overnight growth samples (20 µL) were transferred into Costar 96-well deep plates filled with 380 µL of TB) supplemented with 30 µg/mL chloramphenicol. Cultures were incubated for 2-3 hours in a shaker (250 rpm, 30° C., and 85% relative humidity; Kuhner) and then induced with 40 µL of 10 mM IPTG in sterile water and incubated overnight for 20-24 hours in a shaker (250 rpm, 30° C., and 85% relative humidity; Kuhner). Cells were pelleted (4000 rpm×10 min), supernatants were discarded, and the cells were frozen at −80° C. prior to analysis.

Lysis of HTP Cell Pellets

*E. coli* cell pellets were lysed with 250 µL of lysis buffer (1 mg/ml lysozyme+0.5 g/L PMBS in 20 mM sodium phosphate pH 8, with 150 mM NaCl). The mixture was agitated for 2 hours at room temperature, and pelleted (4000 rpm×10 min), after which the clarified lysates were used in HTP assays described herein.

HTP Activity Analysis of Clarified Lysates

TAL variant activity on tyrosine or phenylalanine was assayed by measuring the formation of coumaric or cinnamic acid, respectively, as determined by the change in absorbance at 290 nm over time. Reactions were prepared by the addition of 160 µL of 2.5 mM tyrosine or phenylalanine dissolved in 200 mM sodium phosphate and 40 µL of clarified lysate to a 96-well UV-STAR® plate (Greiner Bio-One). The reactions were mixed briefly, and the activity was determined by tracking the absorbance at 290 nm over time (every 14-37s over 10 min) using a SPECTRAMAX® Plus 384 or a SPECTRAMAX® 190 (Molecular Devices) absorbance microplate reader. Activity on tyrosine was detected for SEQ ID NOS: 4, 2, 6, and 8 as shown in Table 1-1. Some enzymes also had detectable activity on phenylalanine.

TABLE 1-1

Activity of TAL Variants on Tyrosine and Phenylalanine Under Various Conditions[1]

| SEQ ID NO: (nt/aa) | 2 mM Tyr Activity | 2 mM Phe Activity |
|---|---|---|
| 1/2 | ++++ | |
| 3/4 | ++ | |
| 5/6 | +++ | |
| 7/8 | + | + |

[1]Levels of initial activity (milli-Absorbance Units/min) are defined as follows: "+" > 10; "++" > 20; "+++" > 50; and "++++" > 100.

Example 2

Shake Flask Powder (SFP) Production and Characterization Assays for TAL and TAL Variants In this Example, methods used for the preparation and characterization of shake flask powders of TAL enzymes with tyrosine ammonia lyase activity are described.

Production of Shake Flask Powders (SFP)

*E. coli* cultures transformed with plasmids containing TAL variants were plated onto LBagar plates with 1% glucose and in some instances, 30 µg/mL chloramphenicol, and grown overnight at 37° C. A single colony from each culture was transferred to 5 mL of Luria Broth (LB) with 1% glucose and 30 µg/mL chloramphenicol, where appropriate. The cultures were grown for 18 h at 30° C., 250 rpm, and subcultured approximately 1:50 into 250 ml of TB with 30 µg/mL of chloramphenicol. The cultures were grown for approximately 3-4 h at 30° C., 250 rpm, to an $OD_{600}$ of 0.6-0.8, and induced with 1 mM of IPTG. The cultures were grown for 20 h at 30° C., 250 rpm. Cells were harvested by centrifugation (7000 rpm×10 min, 4° C.), and the supernatants were discarded. The pellets were resuspended in 30 mL of 20 mM sodium phosphate, pH 8.0, with 150 mM NaCl in some instances, and lysed using a single pass through a microfluidizer (Microfluidics), at 110 psi. The lysates were pelleted (10,000× rpm, 30 min, 4° C.), and the supernatants were heated for 1-2 hours at 60-65° C. in a water bath before being pelleted again (10,000× rpm, 1 h, 4° C.). The resulting supernatants were then frozen and lyophilized to generate powders containing the expressed enzymes.

SFP Characterization Assay for Activity on Tyrosine and Phenylalanine

Shake flask powders were reconstituted to provide 10-20 g/L powder and were serially diluted to 0.08-10 g/L. Then, 20 µL of these stocks were added to 180 µL of 2.5 mM tyrosine or phenylalanine dissolved in 200 mM sodium phosphate, pH 7.0, in a 96-well UV-STAR® plate (Greiner Bio-One). The reactions were mixed briefly, and the activity was determined by tracking the absorbance at 290 nm over time (every 14-37s over 5 min) using a SPECTRAMAX® Plus 384 or a SPECTRAMAX® 190 (Molecular Devices) absorbance microplate reader. Results for SEQ ID NOS: 2 and 6 are shown in Table 2-1.

In some cases, TAL enzyme activity on phenylalanine was measured over longer periods of time. Reactions were prepared by adding 20 µL of diluted shake flask powder solution to 180 µL of 2.5 or 12.5 mM phenylalanine dissolved in 200 mM sodium phosphate, pH 7.0. The reactions were mixed briefly, and an initial absorbance was determined by diluting the assay 10-fold in water and measuring the absorbance at 290 nm using a SPECTRAMAX® Plus 384 or a SPECTRAMAX® 190 (Molecular Devices) absorbance microplate reader. After incubation at 37° C. for 1-4 h in a THERMOTRON® (INFORS) titre-plate shaker (400 rpm), the final absorbance was measured in a similar manner. Activity was determined by subtracting the initial from the final absorbance.

SFP Characterization Assay for Resistance to Proteases

To evaluate the relative stability of evolved enzymes to representative proteases, a mix of porcine trypsin (Sigma Aldrich) and bovine chymotrypsin (Sigma Aldrich) were dissolved in 100 mM sodium phosphate, pH 7.0, to a concentration of 8 g/L each and serially diluted 2-fold. Then, 0.5-1 g/L TAL SFP were incubated with 0-4 g/L at 37° C. for 1-2 h at 400 rpm in a THERMOTRON® (INFORS) titre-plate shaker. After incubation, 20-40 µL of the protease-treated SFP was added to 160-180 µL of 2.5 mM tyrosine dissolved in 200 mM sodium phosphate, pH 7.0, and enzyme initial activity was measured as described above. Protease resistance was calculated as a percentage of residual activity against the control (i.e., no protease treatment) sample. Results for SEQ ID NOS: 2 and 6 are shown in Table 2-1.

SFP Characterization Assay for pH Tolerance

To evaluate the relative tolerance of evolved enzymes to acidic pH, SFPs were reconstituted to provide 10 g/L powder and were diluted 10-fold into McIlvaine buffer, pH 4.0-7.0. The mixture was incubated for 1 h at 37° C. for 1-1.5 h at 400 rpm in a THERMOTRON® (INFORS) titre-plate shaker. After incubation, the enzyme solutions were briefly centrifuged, and 20 µL of the solutions were added to 180 µL of 2.5 mM tyrosine dissolved in 200 mM sodium phosphate, pH 7.0. Enzymatic activity was determined as described above, and pH tolerance was calculated as a percentage of residual activity against the control (i.e., pH 7.0) sample.

SFP Characterization Assay for Determination of Kinetic Parameters

To evaluate if the mutations in the TAL variants had altered kinetics, the Michaelis constant ($K_m$) and maximum velocity ($V_{max}$) were determined for each variant. To assay, 20 µl of diluted TAL variants at 1 g/L and 180 µL of 2-fold serially diluted tyrosine (0-2.48 mM tyrosine in 200 mM sodium phosphate, pH 7.0), were added to the wells of a 96-well UV-STAR® plate (Greiner Bio-One). The reactions were mixed briefly, and the activity was determined by tracking the absorbance at 290 nm over time (every 14-37s over 5 min) using a SPECTRAMAX® Plus 384 or a SPECTRAMAX® 190 (Molecular Devices) absorbance microplate reader. The $V_{max}$ and $K_m$ for each tested TAL variant was determined by fitting the data to a Michaelis-Menten equation using non-linear regression. Results for SEQ ID NOS: 2 and 6 are shown in Table 2-1.

SFP Characterization Assay for Thermostability

Improved thermostability is a valuable trait useful in manufacture and storage of enzyme therapeutics and often occurs as a byproduct of other stabilization efforts. To assess the relative stability of the variants produced during the development of the present invention, the thermostability of the variants was assessed as follows: 100 µL of TAL variants at 1 g/L were incubated for 2 h at 60-80° C. in a thermocycler. After incubation, samples were briefly centrifuged, and 20 µL of the heat-treated SFP was added to 180 µL of 2.5 mM tyrosine dissolved in 200 mM sodium phosphate, pH 7.0. Enzymatic activity was determined as described above, and thermostability was calculated as a percentage of residual activity against the control (i.e., 60° C.) sample. Results for SEQ ID NOS: 2 and 6 are shown in Table 2-1.

TABLE 2-1

Activity of TAL Variants on Tyrosine and Phenylalanine Under Various Conditions

| SEQ ID NO: (nt/aa) | Tyr Vmax (mAU/min)[1] | Tyr Km (mM)2 | Protease Resistance (% Residual Activity at 0.5 g/L Protease) | Thermostability (% Residual Activity at 60° C.) |
|---|---|---|---|---|
| 1/2 | +++ | + | + | +++ |
| 5/6 | + | ++ |  | ++++ |

[1]Tyr Vmax is defined as follows: "+" = 0.5-1; "++" > 1; and "+++" > 5.
2Tyr Km is defined as follows: "+" = 0.15-0.05; and "++" < 0.05. The % residual activity for protease and thermostability challenges is defined as follows: "+" = 5-50%; "++" > 50%; "+++" > 75%; and "++++" > 90%.

Example 3

TAL Variants of SEQ ID NO: 2

In this Example, experiments for evolution and screening of TAL variants derived from SEQ ID NO: 2, for improved tyrosine activity and phenylalanine activity are described. Directed evolution of the TAL encoded by SEQ ID NO: 1, was carried out by constructing libraries of variant genes, using methods known in the art. These libraries were then plated, grown, and screened using the methods described below.

HTP Activity Analysis of Clarified Lysates:

HTP growth and lysis of *E. coli* cells expressing TAL variants were performed as described in Example 1. TAL variant activity on tyrosine and phenylalanine were assayed as described in Example 1, with the following conditions: 20 µL of HTP lysate diluted 10-fold in water was assayed with 2.2 mM tyrosine for 5 min, 20 µL of undiluted HTP lysate was assayed with 0.1 mM tyrosine for 10 min, and 50 µL of undiluted HTP lysate was assayed with 10.5 mM phenylalanine for 10 min. The results of the assays are shown in Table 3-1. Based on these results, SEQ ID NO: 14 was selected for further directed evolution.

TABLE 3-1

Relative Activity of TAL Variants on Tyrosine and Phenylalanine Under Various Conditions (Relative to SEQ ID NO: 2)[1]

| SEQ ID NO: (nt/aa) | Amino Acid Differences (Relative to SEQ ID NO: 2) | 2 mM Tyr FIOPC (Relative to SEQ ID NO: 2) | 2 mM Phe FIOPC (Relative to SEQ ID NO: 2) |
|---|---|---|---|
| 9/10 | N99H/V107A/Y184S | + | +++ |
| 11/12 | S79T/V107S/P410K | + | ++++ |
| 13/14 | K95A/V107A/Y184S | ++ | ++++ |
| 15/16 | S79T/P410K | + | +++ |
| 17/18 | V107S/A401P/A534S | + | +++ |
| 19/20 | S79T/K95A/V107S | + | ++++ |
| 21/22 | S79T/V107S | + | +++ |
| 23/24 | K95A/Y184S/A534S | + | +++ |
| 25/26 | V107A/Y184S/A534S | ++ | +++ |
| 27/28 | K95A/V107S/Y184S/A534S | ++ | +++ |

[1]All activities were determined relative to the reference polypeptide SEQ ID NO: 2. Levels of increased activity are defined as follows: ""+"" = 0.9 to 1.2; "++" > 1.2; "+++" > 2; and "++++" > 4.

Example 4

TAL Variants of SEQ ID NO: 14

In this Example, experiments for evolution and screening of TAL variants derived from SEQ ID NO: 14, for improved tyrosine activity, phenylalanine activity, and protease resistance are described. Directed evolution of the TAL encoded by SEQ ID NO: 13, was carried out by constructing libraries of variant genes. These libraries were then plated, grown, and screened using the methods described below.

High-Throughput (HTP) Growth of Cultures Expressing TAL Enzymes

Transformed *E. coli* cells were selected by plating onto LB agar plates containing 1% glucose. After overnight incubation at 37° C., colonies were picked onto NUNC™ (Thermo-Scientific) 96-well shallow flat bottom plates filled with 180 µL/well LB-medium supplemented with 1% glucose. Cultures were allowed to grow overnight for 18-20 hours in a shaker (200 rpm, 30° C., and 85% relative humidity; Kuhner). Overnight growth samples (20 µL) were transferred into Costar 96-well deep plates filled with 380 µL of TB supplemented with 30 µg/mL chloramphenicol. Cultures were incubated for 2-3 hours in a shaker (250 rpm, 30° C., and 85% relative humidity; Kuhner) and then induced with 40 µL of 10 mM IPTG in sterile water and incubated overnight for 20-24 hours in a shaker (250 rpm, 30° C., and 85% relative humidity; Kuhner). Cells were pelleted (4000 rpm×10 min), supernatants were discarded, and cells were frozen at −80° C. prior to analysis.

Lysis of HTP Cell Pellets

*E. coli* cell pellets were lysed with 400 µL of lysis buffer (1 mg/ml lysozyme+0.5 g/L PMBS in 20 mM sodium phosphate pH 8, with 150 mM NaCl). The mixture was agitated for 1.5-2 hours at room temperature, and pelleted (4000 rpm×10 min) after which the clarified lysates were used in HTP assays or preincubated for 2 h at 65° C. in a THERMOTRON® (INFORS) titre-plate shaker (400 rpm). The heat-treated lysates were pelleted (4000 rpm×10 min), and the supernatants were used in HTP assays.

HTP Activity Analysis of Clarified Lysates

TAL variant activity was assayed by measuring the formation of coumaric acid as determined by the change in absorbance at 290 nm over time. Reactions were prepared by the addition of 180 µL of 200 mM sodium phosphate, 0.125 or 2.5 mM tyrosine, pH 7.0, and 20 µL of heat-treated clarified lysate (undiluted for 0.125 mM tyrosine or diluted 5-fold for 2.5 mM tyrosine) to a 96-well UV-STAR® plate (Greiner Bio-One). The reactions were mixed briefly, and the activity was determined by tracking the absorbance at 290 nm over time (every 14-37 s over 5 min) using a SPECTRA® Plus 384 or a SPECTRAMAX® 190 (Molecular Devices) absorbance microplate reader. The results of these assays are shown in Table 4-1, and SEQ ID NO: 86 was selected for further directed evolution.

TAL variant activity on phenylalanine was assayed by measuring the formation of cinnamic acid as determined by the change in absorbance at 290 nm over time. Reactions were prepared by adding 160 µL of 200 mM sodium phosphate, 12 mM phenylalanine, pH 7.0, and 40 µL of heat-treated clarified lysate to a 96-well UV-STAR® plate (Greiner Bio-One). The reactions were mixed briefly, and an initial absorbance was determined by measuring the absorbance at 290 nm using a SPECTRAMAX® Plus 384 or a SPECTRAMAX® 190 (Molecular Devices) absorbance microplate reader. After incubation at 37° C. for 1.5-3 h in a THERMOTRON® (INFORS) titre-plate shaker (400 rpm), the final absorbance was measured in a similar fashion. Activity was determined by subtracting the initial from the final absorbance, and results are shown in Table 4-1.

HTP Activity Analysis of Clarified Lysates Pretreated with Protease

TAL variants were challenged with chymotrypsin and trypsin to simulate the environment of the lower intestine. First, 50 µL of protease mix (0.25 mg/mL chymotrypsin (Sigma Aldrich), 0.25 mg/mL trypsin (Sigma Aldrich)) in 100 mM sodium phosphate pH 7.0 and 50 µL of heat-treated clarified lysate were added to a 96-well round bottom plate (Costar). The plates were sealed and incubated for 1 hour at 37° C. in a THERMOTRON® (INFORS) titre-plate shaker (400 rpm) prior to analysis. Residual activity was determined by adding 40 µL of the protease-treated lysate to 160 µL of 200 mM sodium phosphate, 2.5 mM tyrosine, pH 7.0, in a 96-well UV-STAR® plate (Greiner Bio-One). The reactions were mixed briefly, and activity was determined as described in Example 3. The results of this assay are shown in Table 4-1.

TABLE 4-1

Relative Activity of TAL Variants on Tyrosine and Phenylalanine Under Various Conditions (Relative to SEQ ID NO: 14)[1]

| SEQ ID NO: (nt/aa) | Amino Acid Differences (Relative to SEQ ID NO: 14) | 2 mM Tyr FIOPC | Protease FIOPC | 0.1 mM Tyr FIOPC | 10 mM Phe FIOPC |
|---|---|---|---|---|---|
| 29/30 | K33D/K34E/Q37S/T90S/K554Q | ++ | +++ | ++ | ++ |
| 31/32 | A289R/K554Q | ++ | ++ | ++ | ++ |
| 33/34 | K33D/Q66N/A289R/K554Q | ++ | +++ | ++ | ++ |
| 35/36 | K34E/L46R | +++ | +++ | ++ | ++ |
| 37/38 | K33D/Q66N/A289R | ++ | ++ | ++ | ++ |
| 39/40 | K33D/K34E/T90S/A289R/K554Q | ++ | +++ | ++ | ++ |
| 41/42 | K33D/Q66N | ++ | ++ | ++ | ++ |
| 43/44 | K34E/T90S/A289R/K554Q | ++ | ++ | ++ | ++ |
| 45/46 | K34E/K56G/T90S/A289R | ++ | ++ | ++ | ++ |
| 47/48 | Q66N/T90S/Q279D/A289R/K554Q | ++ | ++ | ++ | ++ |
| 49/50 | T90S/A289R/K554Q | ++ | ++ | ++ | ++ |
| 51/52 | K34E/Q66N/A289R | ++ | ++ | ++ | ++ |
| 53/54 | K33D/K34E/Q37S/L46R/Q279S/K554Q | ++ | +++ | ++ | ++ |
| 55/56 | K33D/K34E/L46R/Q66N/T90S/A289R | ++ | ++ | ++ | ++ |
| 57/58 | K34E/Q37R/L46R/A289R | ++ | +++ | ++ | ++ |
| 59/60 | K33D/K34E/Q279S/A289R | ++ | +++ | ++ | ++ |
| 61/62 | K34E/K56G/T90S | ++ | ++ | ++ | ++ |
| 63/64 | K34E/Q37S/Q66N/Q279S/A289R | ++ | ++ | ++ | ++ |

TABLE 4-1-continued

Relative Activity of TAL Variants on Tyrosine and Phenylalanine
Under Various Conditions (Relative to SEQ ID NO: 14)[1]

| SEQ ID NO: (nt/aa) | Amino Acid Differences (Relative to SEQ ID NO: 14) | 2 mM Tyr FIOPC | Protease FIOPC | 0.1 mM Tyr FIOPC | 10 mM Phe FIOPC |
|---|---|---|---|---|---|
| 65/66 | Q279S/A289R/K554Q | ++ | ++ | ++ | ++ |
| 67/68 | T90S/A289R/A519P | ++ | ++ | ++ | + |
| 69/70 | K34E/T90S/A519P | ++ | ++ | ++ | ++ |
| 71/72 | Q66N/T90S/A289R/K554Q | ++ | ++ | ++ | ++ |
| 73/74 | A289R/A519P/K554Q | ++ | ++ | ++ | ++ |
| 75/76 | L46R/Q66N/A289R/A519P/K554Q | ++ | ++ | ++ | ++ |
| 77/78 | S79T/E304G/L361M | ++ | +++ | ++ | + |
| 79/80 | S79T/Q111K/N531D | ++ | +++ | ++ | ++ |
| 81/82 | S79T/S407V/L461M | ++ | +++ | + | ++ |
| 83/84 | S79T/Q111K/Y234H/L361M/C500T | ++ | ++++ | + | ++ |
| 85/86 | S70K/S79T/Y234H/L361M/S407V | ++ | ++++ | + | ++ |
| 87/88 | E304G/L361M | ++ | +++ | ++ | + |
| 89/90 | S79T/E304G/L461M/N531D | ++ | +++ | ++ | + |
| 91/92 | S70K/E304G/S407V/L461M | ++ | +++ | ++ | ++ |
| 93/94 | S79T/Q111K/Y234H/N531D | ++ | +++ | ++ | ++ |
| 95/96 | A36V/S407V/L461M/C500T/N531D | ++ | ++ | ++ | ++ |
| 97/98 | A36V/Q111K/E304G/L461M/N531D | ++ | ++ | ++ | + |
| 99/100 | L461M/C500T | ++ | ++ | ++ | ++ |
| 101/102 | S70K/Q111K/L461M/C500T/N531D | ++ | +++ | ++ | ++ |
| 103/104 | L361M/C500Q/N531D | ++ | ++ | ++ | + |
| 105/106 | A36V/S79T/S407V/L461M/C500T/N531D | ++ | ++++ | ++ | ++ |
| 107/108 | A36V/S70K/Y234H/R302M/L461M/C500T | ++ | +++ | ++ | |
| 109/110 | A36V/S79T | + | +++ | + | ++ |
| 111/112 | A36V/S79T/E304G/S407V | + | +++ | ++ | + |
| 113/114 | N531D | ++ | ++ | ++ | ++ |
| 115/116 | S79T/Q111K/L361M | ++ | ++++ | ++ | ++ |
| 117/118 | S548R | ++ | +++ | ++ | ++ |
| 119/120 | A544E | ++ | +++ | ++ | ++ |
| 121/122 | K28G | +++ | +++ | +++ | ++ |
| 123/124 | E522K | ++ | ++++ | ++ | ++ |
| 125/126 | A540R | ++ | +++ | ++ | ++ |
| 127/128 | A544G | ++ | +++ | ++ | ++ |
| 129/130 | T547S | ++ | +++ | ++ | ++ |
| 131/132 | Q558A | ++ | ++ | ++ | ++ |
| 133/134 | A544S | ++ | +++ | +++ | ++ |
| 135/136 | R524Y | ++ | ++ | ++ | ++ |
| 137/138 | L295Q | +++ | ++ | +++ | + |
| 139/140 | T547C | ++ | ++ | ++ | ++ |
| 141/142 | L541A | ++ | +++ | ++ | ++ |
| 143/144 | I491V | ++ | ++ | ++ | ++ |
| 145/146 | E522G | ++ | +++ | ++ | ++ |
| 147/148 | Q66S | ++ | ++ | ++ | ++ |
| 149/150 | S548Q | ++ | ++ | ++ | ++ |
| 151/152 | K518E | ++ | +++ | ++ | ++ |
| 153/154 | P29E | ++ | +++ | ++ | ++ |
| 155/156 | E522R | ++ | ++++ | ++ | ++ |
| 157/158 | T547Q | +++ | +++ | ++ | ++ |
| 159/160 | S548T | ++ | +++ | ++ | ++ |
| 161/162 | K490I | +++ | ++ | +++ | ++ |
| 163/164 | K518V | +++ | +++ | ++ | ++ |
| 165/166 | V88Q | +++ | ++ | +++ | ++ |
| 167/168 | E522V | ++ | +++ | ++ | ++ |
| 169/170 | K201R | ++ | ++ | ++ | ++ |
| 171/172 | K554S | ++ | +++ | ++ | ++ |
| 173/174 | K28N | ++ | +++ | ++ | ++ |
| 175/176 | K28C | ++ | +++ | ++ | ++ |
| 177/178 | A278S | ++ | ++ | ++ | ++ |
| 179/180 | I491L | ++ | ++ | ++ | ++ |
| 181/182 | K33N | ++ | +++ | ++ | ++ |
| 183/184 | P29R | ++ | ++ | ++ | ++ |
| 185/186 | A540E | ++ | +++ | ++ | ++ |
| 187/188 | R524Q | +++ | +++ | +++ | ++ |
| 189/190 | T547A | +++ | +++ | ++ | ++ |
| 191/192 | H131M | +++ | ++ | +++ | ++ |
| 193/194 | S548K | ++ | +++ | ++ | ++ |
| 195/196 | E522Y | ++ | ++ | ++ | ++ |
| 197/198 | P29A | ++ | ++ | ++ | ++ |
| 199/200 | K554Y | ++ | ++ | ++ | + |
| 201/202 | V560R | ++ | ++ | ++ | ++ |
| 203/204 | K490A | +++ | ++ | +++ | ++ |
| 205/206 | T49N | ++ | +++ | ++ | ++ |
| 207/208 | K28A | ++ | ++ | ++ | ++ |
| 209/210 | T547K | ++ | +++ | ++ | ++ |

TABLE 4-1-continued

Relative Activity of TAL Variants on Tyrosine and Phenylalanine
Under Various Conditions (Relative to SEQ ID NO: 14)[1]

| SEQ ID NO: (nt/aa) | Amino Acid Differences (Relative to SEQ ID NO: 14) | 2 mM Tyr FIOPC | Protease FIOPC | 0.1 mM Tyr FIOPC | 10 mM Phe FIOPC |
|---|---|---|---|---|---|
| 211/212 | A519Q | ++ | +++ | +++ | ++ |
| 213/214 | L46R | ++ | ++ | ++ | ++ |
| 215/216 | R524A | ++ | ++ | ++ | ++ |
| 217/218 | Q558H | ++ | ++ | ++ | ++ |
| 219/220 | R524T | ++ | ++ | ++ | ++ |
| 221/222 | Q66R | +++ | +++ | +++ | ++ |
| 223/224 | V88E | +++ | ++ | ++ | + |
| 225/226 | Q37A | ++ | ++ | ++ | ++ |
| 227/228 | S548A | ++ | ++ | ++ | ++ |
| 229/230 | V560T | ++ | ++ | ++ | ++ |
| 231/232 | P272S | ++ | ++ | ++ | ++ |
| 233/234 | A519L | ++ | ++ | ++ | ++ |
| 235/236 | K490V | ++ | ++ | ++ | ++ |
| 237/238 | K554R | ++ | +++ | ++ | ++ |
| 239/240 | L510K | ++ | +++ | ++ | ++ |
| 241/242 | T547G | ++ | ++ | ++ | ++ |
| 243/244 | S548G | ++ | +++ | ++ | ++ |
| 245/246 | R524L | +++ | +++ | +++ | ++ |
| 247/248 | Q558S | +++ | +++ | ++ | ++ |
| 249/250 | T547R | +++ | +++ | +++ | ++ |
| 251/252 | N557E | +++ | +++ | +++ | +++ |
| 253/254 | T49D | +++ | +++ | +++ | +++ |
| 255/256 | E72T | +++ | ++ | ++ | + |
| 257/258 | Q558D | +++ | +++ | +++ | +++ |
| 259/260 | V560G | ++ | ++ | ++ | ++ |
| 261/262 | E523D | ++ | +++ | ++ | ++ |
| 263/264 | P29G | ++ | ++ | ++ | +++ |
| 265/266 | E523I | + | + | + | + |
| 267/268 | A519E | +++ | +++ | ++ | ++ |
| 269/270 | E523S | ++ | ++ | ++ | ++ |
| 271/272 | K554E | ++ | +++ | ++ | ++ |
| 273/274 | L46T | ++ | ++ | ++ | ++ |
| 275/276 | R524I | +++ | ++ | ++ | ++ |
| 277/278 | Q305H | +++ | ++ | +++ | ++ |
| 279/280 | V560M | ++ | +++ | ++ | ++ |
| 281/282 | Q142R | ++ | ++ | ++ | ++ |
| 283/284 | A519D | ++ | ++ | ++ | ++ |
| 285/286 | E523A | ++ | ++ | ++ | ++ |
| 287/288 | E523H | ++ | ++ | ++ | ++ |
| 289/290 | H131S | ++ | ++ | ++ | ++ |
| 291/292 | K28T | ++ | ++ | ++ | ++ |
| 293/294 | H131W | ++ | ++ | ++ | ++ |
| 295/296 | A69S | ++ | ++ | ++ | ++ |
| 297/298 | K490S | ++ | + | ++ | ++ |
| 299/300 | P29W | ++ | ++ | ++ | ++ |
| 301/302 | A519P | ++ | ++ | ++ | ++ |
| 303/304 | Q37D | +++ | +++ | +++ | +++ |
| 305/306 | H131G | + | +++ | ++ | ++++ |
| 307/308 | A350G | +++ | +++ | ++ | ++ |
| 309/310 | K56R | ++ | ++ | ++ | ++ |
| 311/312 | E198R | + | + | ++ | + |
| 313/314 | S521D | +++ | +++ | ++ | ++ |
| 315/316 | Q499T | ++ | ++ | ++ | ++ |
| 317/318 | K56G | +++ | +++ | +++ | +++ |
| 319/320 | N557R | ++ | ++ | ++ | ++ |
| 321/322 | A544R | +++ | +++ | ++ | ++ |

[1]All activities were determined relative to the reference polypeptide SEQ ID NO: 14. Levels of increased activity are defined as follows: ""+"" = 0.9 to 1.1; "++" > 1.1; "+++" > 2; and "++++" > 3.

Example 5

TAL Variants of SEQ ID NO: 86

In this Example, experiments for evolution and screening of TAL variants derived from SEQ ID NO: 86 for improved tyrosine activity, phenylalanine activity, protease resistance, and low pH tolerance are described. Directed evolution of the TAL encoded by SEQ ID NO: 85, was carried out by constructing libraries of variant genes using methods known in the art. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine and phenylalanine were assayed as described in Example 4, with the following conditions: 20 µL of HTP lysate diluted 4- or 5-fold in water was assayed with 2.2 mM tyrosine for 5 min, 20 µL of undiluted HTP lysate was assayed with 0.1 mM tyrosine for 5 min, and 20

µL of undiluted HTP lysate was assayed with 10.8 mM phenylalanine for 2 h. The results of the assays are shown in Table 5-1. SEQ ID NO: 334 was selected for further directed evolution.

HTP Activity Analysis of Clarified Lysates Pretreated with Protease

TAL variants were challenged with chymotrypsin and trypsin, and 50 µL of heat-treated clarified lysate were incubated with 50 µL of protease mix consisting of 8 mg/mL chymotrypsin (Sigma Aldrich) and 8 mg/mL trypsin (Sigma Aldrich) in 100 mM sodium phosphate pH 7.0. Residual activity on tyrosine was measured as described in Example 4, and the results of this assay are shown in Table 5-1.

HTP Activity Analysis of Clarified Lysates Pretreated with Acidic Buffer

TAL variants were challenged with acidic buffer to simulate the gastric environment. First, 50 µL of McIlvaine buffer pH 4 or 4.2, and 50 µL of heat-treated clarified lysate were added to a 96-well round bottom plate (Costar). The plates were sealed and incubated for 1 hour at 37° C. in a THERMOTRON® (INFORS) titre-plate shaker (400 rpm) prior to analysis. After incubation, the lysate solutions were briefly centrifuged, and residual activity was determined by adding 40 µL of the acidic buffer-treated lysate to 160 µL of 200 mM sodium phosphate, 2.5 mM tyrosine, pH 7.0, in a 96-well UV-STAR® plate (Greiner Bio-One). The reactions were mixed briefly, and activity was determined as described in Example 4. The results of this assay are shown in Table 5-1.

Example 6

TAL Variants of SEQ ID NO: 334

In this Example, experiments for evolution and screening of TAL variants derived from SEQ ID NO: 334 for improved tyrosine activity, phenylalanine activity, protease resistance, and low pH tolerance are described. Directed evolution of the TAL encoded by SEQ ID NO: 333, was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4, with the following conditions: 20 µL of HTP lysate diluted 4-10-fold in water was assayed with 2.2 mM tyrosine for 5 min and 20 µL of undiluted HTP lysate was assayed with 0.1 mM tyrosine for 5 min. TAL variant activity on phenylalanine was assayed as described in Examples 1 and 4, with the following conditions: 20 µL of undiluted HTP lysate was assayed with 2.2 mM phenylalanine for 5 min at room temperature or for 1-3 h at 37° C. The results of the assays are shown in Table 6-1. SEQ ID NO: 388 was selected for further directed evolution.

HTP Activity Analysis of Clarified Lysates Pretreated with Protease

TAL variants were challenged with chymotrypsin and trypsin as described in Example 4, and 50 µL of heat-treated clarified lysate was incubated with either 50 µL 8 g/L

TABLE 5-1

Relative Activity of TAL Variants on Tyrosine and Phenylalanine Under Various Conditions (Relative to SEQ ID NO: 86)[1]

| SEQ ID NO: (nt/aa) | Amino Acid Differences (Relative to SEQ ID NO: 86) | 2 mM Tyr FIOPC | Protease FIOPC | 0.1 mM Tyr FIOPC | pH 4 FIOPC | 10 mM Phe FIOPC |
|---|---|---|---|---|---|---|
| 323/324 | K33D/K34E/Q66N/A289R/E522K/N531D | ++ | ++ | ++ | ++++ | ++ |
| 325/326 | K33D/K34E/K70S/H234Y/A289R/A519P | ++ | ++ | ++ | ++++ | ++ |
| 327/328 | K34E/Q66N/K70S/H234Y/K518V/A519P/T547Q | +++ | +++ | ++ | ++++ | ++ |
| 329/330 | K33N/K34E/T49N/H234Y/N531D/T547Q/K554Q | ++ | ++ | ++ | ++++ | ++ |
| 331/332 | K34E/Q66N/N531D/K554Q | +++ | +++ | ++ | +++ | ++ |
| 333/334 | K34E/A289R/E522K/A544E/K554Q | +++ | ++ | +++ | ++++ | ++ |
| 335/336 | K33D/K34E/K70S/H234Y/K518V/A519P/T547Q/K554Q | ++ | ++ | ++ | +++ | ++ |
| 337/338 | Q66N/K70S/H234Y | ++ | ++ | + | +++ | + |
| 339/340 | K34E/H234Y/E522K/K554Q | ++ | ++ | +++ | ++++ | ++ |
| 341/342 | K34E/K70S/A289R/E522K | ++ | ++ | ++ | ++ | + |
| 343/344 | K34E/A289R | ++ | ++ | ++ | +++ | ++ |
| 345/346 | H234Y/N531D/A544E/T547Q | ++ | ++ | ++ | +++ | ++ |
| 347/348 | K33D/K34E/Q66N/K70S/A519P/N531D | +++ | +++ | + | +++ | ++ |
| 349/350 | K34E/T49N/Q66N/N531D | +++ | ++ | ++ | +++ | ++ |
| 351/352 | K34E/K70S/H234Y/A289R/E522K | ++ | ++ | ++ | ++++ | + |
| 353/354 | K28N/K34E/T49N/K70S/H234Y/A289R/A544E/K554Q | +++ | ++ | ++ | +++ | ++ |
| 355/356 | K33D/K34E/K70S/A289R/E522K/K554Q | +++ | ++ | ++ | +++ | ++ |
| 357/358 | K33D/K34E/A289R/E522K/N531D | +++ | ++ | ++ | ++++ | ++ |
| 359/360 | K34E/K70S/H234Y/K554Q | +++ | ++ | ++ | ++++ | ++ |
| 361/362 | K34E/T49N/A289R/A544E/T547Q | +++ | ++ | +++ | +++ | ++ |
| 363/364 | K34E/A289R/E522K/N531D | +++ | +++ | ++ | ++++ | ++ |
| 365/366 | K34E/Q66N/K554Q | +++ | ++ | +++ | +++ | ++ |
| 367/368 | K34E/A544E | ++ | ++ | +++ | +++ | ++ |
| 369/370 | K34E/T49N/H234Y/N531D/K554Q | +++ | +++ | +++ | ++++ | ++ |
| 371/372 | K34E/E522K | ++ | ++ | +++ | +++ | ++ |

[1]All activities were determined relative to the reference polypeptide SEQ ID NO: 86. Levels of increased activity are defined as follows: "'+'" = 0.9 to 1.2; "++" > 1.2; "+++" > 2; and "++++" > 3.

protease mix for 1 h at 37° C. or with 4 g/L protease mix for 2 h at 37° C. Residual activity was determined by adding 20 μL of the protease-treated lysate to 180 μL of 200 mM sodium phosphate, 2.5 mM tyrosine, pH 7.0, in a 96-well UV-Star® plate (Greiner Bio-One). The reactions were mixed briefly, and activity was determined as described in Example 4. The results of this assay are shown in Table 6-1.

HTP Activity Analysis of Clarified Lysates Pretreated with Acidic Buffer

TAL variants were challenged with acidic buffer as described in Example 5, and 50 μL of heat-treated clarified lysate was incubated with 50 μL McIlvaine buffer pH 4. Residual activity was determined as described in Example 5, and the results of this assay are shown in Table 6-1.

TABLE 6-1

Relative Activity of TAL Variants on Tyrosine and Phenylalanine Under Various Conditions (Relative to SEQ ID NO: 334)[1]

| SEQ ID NO: (nt/aa) | Amino Acid Differences (Relative to SEQ ID NO: 334) | 2 mM Tyr FIOPC | Protease FIOPC | 0.1 mM Tyr FIOPC | pH 4 FIOPC | 2 mM Phe FIOPC |
|---|---|---|---|---|---|---|
| 373/374 | I336V | ++ | ++ | + | ++ | + |
| 375/376 | L506R | ++ | + | + | + | + |
| 377/378 | A43T/S59A/L93Q/L506R | + | + | + | + | + |
| 379/380 | Q237R/N238V/L506R | + | + | + | + | + |
| 381/382 | A65N/I336V | ++ | + | + | + | + |
| 383/384 | P306L/L506R | ++ | + | + | ++ | + |
| 385/386 | A43T/P306L | ++ | | + | ++ | + |
| 387/388 | L93Q/L506R | + | ++ | + | + | + |
| 389/390 | P306L | ++ | + | + | ++ | + |
| 391/392 | A43T/P306L/L506R | + | | + | + | + |
| 393/394 | R103W/P306L/L506R | + | + | + | ++ | + |
| 395/396 | K56G/H234Y/C500T | + | ++ | + | ++ | + |
| 397/398 | Q37D/T49N/K56G/C500T/R524Q | ++ | ++ | + | + | + |
| 399/400 | Q66N | ++ | ++ | ++ | ++ | + |
| 401/402 | Q37D/T49N/Q111K/R524Q | ++ | + | ++ | ++ | + |
| 403/404 | Q66N/Q111K/H234Y/C500T | + | ++ | + | + | + |
| 405/406 | T49N/K56G/Q66N/Q111K/T153N/H234Y/C500T/R524Q | + | + | + | ++ | + |
| 407/408 | Q37D/Q111K | ++ | ++ | + | + | + |
| 409/410 | H234Y | ++ | | ++ | ++ | + |
| 411/412 | Q37D/H234Y | + | + | + | ++ | + |
| 413/414 | Q37D/T49N/Q66N/Q111K/H234Y | + | ++ | + | + | + |
| 415/416 | Q111K/M361L | ++ | | + | ++ | + |
| 417/418 | Q558D | + | ++ | + | ++ | + |
| 419/420 | T49N/Q66N | ++ | + | + | ++ | + |
| 421/422 | Q37D/T49N/K56G/Q66N/Q111K | + | + | + | ++ | + |
| 423/424 | M361L/R524Q/N557E/Q558D | + | + | + | + | + |
| 425/426 | Q37D/T49N/K56G/H234Y/N557E | ++ | + | + | ++ | + |
| 427/428 | Q37D/Q111K/M361L/C500T/N557E/Q558D | ++ | ++ | ++ | ++ | + |
| 429/430 | Q111K/H234Y/S548K/Q558D | ++ | ++ | ++ | + | + |
| 431/432 | H234Y/R524Q | ++ | ++ | ++ | + | + |
| 433/434 | K56G/Q111K/H234Y | ++ | + | ++ | ++ | + |
| 435/436 | T421S | ++ | | ++ | + | + |
| 437/438 | A107T/G417A/T421A | + | | | | + |
| 439/440 | G417A/T421S | ++ | ++ | + | + | ++ |
| 441/442 | A107T | ++ | + | ++ | ++ | + |
| 443/444 | R103W/T421S | | + | + | + | ++ |
| 445/446 | A172S | | | | | + |
| 447/448 | R103W/A107T/G417A/T421S | + | + | + | ++ | + |
| 449/450 | R103W | | + | + | + | + |
| 451/452 | Y104F/H105M | | | | | ++++ |
| 453/454 | A504R | + | + | + | + | + |
| 455/456 | S328A | + | + | + | + | + |
| 457/458 | E145V | + | + | + | + | + |
| 459/460 | Q471Y | + | + | + | | + |
| 461/462 | R103L | + | + | + | + | ++ |
| 463/464 | G549D | + | + | + | + | + |
| 465/466 | C61V | | ++ | + | | + |
| 467/468 | E304N | | ++ | | | + |
| 469/470 | V407T | + | | + | + | |
| 471/472 | L211K | + | | | | + |
| 473/474 | H155S | + | + | + | | + |
| 475/476 | T146K | + | + | ++ | + | + |
| 477/478 | A95K | + | + | + | + | |
| 479/480 | A65M | | | + | | + |
| 481/482 | A286Q | + | + | + | + | + |
| 483/484 | A95V | + | | ++ | + | + |
| 485/486 | T31S | + | + | + | + | + |
| 487/488 | P197T | + | | + | + | + |
| 489/490 | V407K | + | + | + | + | + |
| 491/492 | H155L | + | + | + | + | + |

TABLE 6-1-continued

Relative Activity of TAL Variants on Tyrosine and Phenylalanine
Under Various Conditions (Relative to SEQ ID NO: 334)[1]

| SEQ ID NO: (nt/aa) | Amino Acid Differences (Relative to SEQ ID NO: 334) | 2 mM Tyr FIOPC | Protease FIOPC | 0.1 mM Tyr FIOPC | pH 4 FIOPC | 2 mM Phe FIOPC |
|---|---|---|---|---|---|---|
| 493/494 | A286R | + |  | + |  | + |
| 495/496 | L506V | + | + | ++ | + | + |

[1]All activities were determined relative to reference polypeptide SEQ ID NO: 334. Levels of increased activity are defined as follows: "+" = 0.9 to 1.2; "++" > 1.2; "+++" > 2; and "++++" > 3.

Example 7

TAL Variants of SEQ ID NO: 388

In this Example, experiments for evolution and screening of TAL variants derived from SEQ ID NO: 388 for improved tyrosine activity, phenylalanine activity, protease resistance, and low pH tolerance are described. Directed evolution of the TAL encoded by SEQ ID NO: 387, was carried out by constructing libraries of variant genes. These libraries were then plated, grown, and screened using the methods described below.

HTP Activity Analysis of Clarified Lysates

HTP growth and lysis of E. coli cells expressing TAL variants were performed as described in Example 4. TAL variant activity on tyrosine was assayed as described in Example 4, with the following conditions: 20 μL of HTP lysate diluted 10-fold in water was assayed with 2.2 mM tyrosine for 5 min and 20 μL of undiluted HTP lysate was assayed with 0.1 mM tyrosine for 5 min. TAL variant activity on phenylalanine was assayed as described in Example 4 with the following conditions: 20 μL of undiluted HTP lysate was assayed with 2.2 mM phenylalanine for 5 min at room temperature or for 2 h at 37° C. The results of the assays are shown in Table 7-1. SEQ ID NO: 604 was selected for further directed evolution.

HTP Activity Analysis of Clarified Lysates Pretreated with Protease

TAL variants were challenged with chymotrypsin and trypsin as described in Example 4, and 50 μL of heat-treated clarified lysate was incubated with 50 μL 8 g/L protease mix for 2 h at 37° C. Residual activity was determined as described in Example 6. The results of this assay are shown in Table 7-1.

HTP Activity Analysis of Clarified Lysates Pretreated with Acidic Buffer

TAL variants were challenged with acidic buffer as described in Example 5, and 50 μL of heat-treated clarified lysate was incubated with 50 μL McIlvaine buffer pH 4. Residual activity was determined by adding 20 μL of the acidic buffer-treated lysate to 180 μL of 200 mM sodium phosphate, 2.5 mM tyrosine, pH 7.0, in a 96-well UV-Star® plate (Greiner Bio-One). The reactions were mixed briefly, and activity was determined as described in Example 4. The results of this assay are shown in Table 7-1.

TABLE 7-1

Relative Activity of TAL Variants on Tyrosine and Phenylalanine
Under Various Conditions (Relative to SEQ ID NO: 388)[1]

| SEQ ID NO: (nt/aa) | Amino Acid Differences (Relative to ID NO: 388) | 2 mM Tyr FIOPC | Protease FIOPC | 0.1 mM Tyr FIOPC | pH 4 FIOPC | 2 mM Phe FIOPC |
|---|---|---|---|---|---|---|
| 497/498 | Q66N/R103L/E145V/H234Y/T421S | ++ | ++ | ++ | ++++ | ++ |
| 499/500 | S59A/E145V | ++ | ++ | ++ | ++++ | ++ |
| 501/502 | T49N/S59A/Q66N/Q111K/E145V/H234Y | ++ | +++ | ++ | ++++ | + |
| 503/504 | Q111K/E145V/H234Y | ++ | ++ | ++ | ++++ | + |
| 505/506 | K56G/Q66N/E145V/C500T | ++ | ++ | ++ | ++++ | + |
| 507/508 | K56G/S59A/Q66N/H234Y | ++ | +++ | ++ | ++++ | ++ |
| 509/510 | R103L/Q111K/E145V/H234Y/T421S | ++ | ++ | ++ | ++++ | ++ |
| 511/512 | Q111K/H234Y | ++ | ++ | ++ | ++++ | ++ |
| 513/514 | K56G/S59A/Q111K/E145V/H234Y/T421S | ++ | ++ | ++ | ++++ | ++ |
| 515/516 | T49N/K56G/S59A/H234Y/C500T | ++ | +++ | ++ | ++++ | ++ |
| 517/518 | S59A/H234Y | ++ | ++ | ++ | ++++ | ++ |
| 519/520 | E145V/H234Y/C500T | ++ | ++ | ++ | ++++ | + |
| 521/522 | K56G/R103L/Q111K/E145V/H234Y/C500T | ++ | +++ | ++ | ++++ | ++ |
| 523/524 | Q37D/R103L/Q111K/E145V/T421S/C500T/R524Q | ++ | ++ | ++ | ++++ | ++ |
| 525/526 | K56G/S59A/Q111K/E145V | ++ | ++ | ++ | ++++ | + |
| 527/528 | S59A/R103L/E145V/H234Y/T421S/C500T | ++ | ++ | ++ | ++++ | ++ |
| 529/530 | T49N/S59A/E145V/H234Y/T421S | ++ | ++ | ++ | ++++ | ++ |
| 531/532 | Q37D/T49N/K56G/S59A/E145V | ++ | +++ | ++ | ++ | ++ |
| 533/534 | S59A/R103L/H234Y/T421S | ++ | ++ | ++ | ++++ | ++ |
| 535/536 | C61V/V407T | + | ++ | + |  | ++ |
| 537/538 | A286Q/S328A/V407T/A504R/G549D | ++ | ++ | ++ | ++++ | + |

TABLE 7-1-continued

Relative Activity of TAL Variants on Tyrosine and Phenylalanine
Under Various Conditions (Relative to SEQ ID NO: 388)[1]

| SEQ ID NO: (nt/aa) | Amino Acid Differences (Relative to ID NO: 388) | 2 mM Tyr FIOPC | Protease FIOPC | 0.1 mM Tyr FIOPC | pH 4 FIOPC | 2 mM Phe FIOPC |
|---|---|---|---|---|---|---|
| 539/540 | C61V/S328A/A504R | + | ++ | + | ++++ | ++ |
| 541/542 | A95K/V407T | ++ | ++ | ++ | | + |
| 543/544 | T31S/A95K/A286Q/A504R/G549D | ++ | ++ | + | ++++ | + |
| 545/546 | C61V/A95K/S328A/V407T | ++ | +++ | ++ | ++ | + |
| 547/548 | T31S/A95K/S328A/A504R | ++ | ++ | ++ | + | + |
| 549/550 | C61V/A95K/V407T | ++ | +++ | ++ | ++ | ++ |
| 551/552 | G549D | ++ | ++ | + | ++++ | ++ |
| 553/554 | A95K/A286Q | ++ | ++ | ++ | | + |
| 555/556 | C61V/A504R | + | ++ | + | ++++ | ++ |
| 557/558 | A95K/A286Q/S328A/A504R | ++ | ++ | ++ | ++++ | + |
| 559/560 | A95K/H155S/A286Q/G549D | ++ | ++ | ++ | ++++ | + |
| 561/562 | T31S/A95K/H155S/A286Q/A504R/G549D | ++ | ++ | ++ | ++++ | + |
| 563/564 | T31S/A95K/G549D | ++ | ++ | ++ | ++++ | + |
| 565/566 | C61V/A95K/A504R/T547Q | ++ | +++ | ++ | +++ | ++ |
| 567/568 | A95K/H155S/A286Q/S328A/V407T/A504R | ++ | ++ | ++ | +++ | + |
| 569/570 | T31S/A95K/A504R | ++ | ++ | ++ | ++ | + |
| 571/572 | A95K/A286Q/T547Q | ++ | ++ | ++ | | + |
| 573/574 | C61V/S328A/A504R/G549D | + | +++ | + | ++++ | ++ |
| 575/576 | T31S/C61V/A95K/Q471Y/A504R | ++ | +++ | ++ | ++++ | ++ |
| 577/578 | C61V/A286Q/V407T | + | +++ | ++ | ++ | ++ |
| 579/580 | A95K/S328A/A504R | ++ | ++ | ++ | ++ | + |
| 581/582 | A95K/V407T/A504R | ++ | ++ | ++ | ++ | + |
| 583/584 | T31S/C61V/V407T/A504R | + | ++ | + | ++ | ++ |
| 585/586 | A95K/G549D | ++ | +++ | ++ | ++++ | + |
| 587/588 | T31S/A95K/A286Q/A504R | ++ | ++ | ++ | ++ | + |
| 589/590 | T31S/A95K/Q237K/A504R/T547Q/G549D | ++ | +++ | ++ | ++++ | + |
| 591/592 | C61V | + | +++ | + | ++ | ++ |
| 593/594 | C61V/A95K/S328A/G549D | ++ | +++ | ++ | ++++ | ++ |
| 595/596 | C61V/A95K/A286Q | ++ | +++ | ++ | + | ++ |
| 597/598 | C61V/A95K/A286Q/S328A/A504R | ++ | +++ | ++ | ++++ | ++ |
| 599/600 | C61V/A95K/H155S/A286Q/V407T/Q471Y | ++ | ++ | ++ | ++++ | + |
| 601/602 | T31S/C61V/A95K/V407T/A504R | ++ | ++ | ++ | ++ | ++ |
| 603/604 | A95K/A286Q/S328A/V407T/A504R | ++ | ++ | ++ | +++ | + |
| 605/606 | A95K/G287S/A504R/G549D | ++ | ++ | ++ | ++++ | + |
| 607/608 | T31S/C61V/A95K/A286Q/S328A | ++ | +++ | ++ | + | ++ |
| 609/610 | C61V/S328A | + | ++ | + | ++ | ++ |
| 611/612 | A95K/A504R/T547Q | ++ | ++ | ++ | + | + |
| 613/614 | C61V/A95K/H155S/V407T | ++ | ++ | + | ++++ | + |

[1]All activities were determined relative to reference polypeptide SEQ ID NO: 388. Levels of increased activity are defined as follows: "+" = 0.9 to 1.2; "++" > 1.2; "+++" > 2; and "++++" > 3.

Example 8

TAL Variants of SEQ ID NO: 604

In this Example, experiments for evolution and screening of TAL variants derived from SEQ ID NO: 604, for improved tyrosine activity, protease resistance, and low pH tolerance are described. Directed evolution of the TAL encoded by SEQ ID NO: 603, was carried out by constructing libraries of variant genes. These libraries were then plated, grown, and screened using the methods described below.

HTP Activity Analysis of Clarified Lysates

HTP growth and lysis of E. coli cells expressing TAL variants were performed as described in Example 4. TAL variant activity on tyrosine was assayed as described in Example 4, with the following conditions: 20 µL of HTP lysate diluted 10-fold in water was assayed with 2.2 mM tyrosine for 5 min and 20 µL of undiluted HTP lysate was assayed with 0.1 mM tyrosine for 5 min. The results of the assays are shown in Table 8-1. SEQ ID NO: 736 was selected for further directed evolution.

HTP Activity Analysis of Clarified Lysates Pretreated with Protease

TAL variants were challenged with chymotrypsin and trypsin as described in Example 4, and 50 µL of HTP lysate diluted 2-fold was incubated with 50 µL 3 g/L protease mix for 1 h at 37° C. Residual activity was determined as described in Example 4. The results of this assay are shown in Table 8-1.

HTP Activity Analysis of Clarified Lysates Pretreated with Acidic Buffer

TAL variants were challenged with acidic buffer as described in Example 5, and 40 µL of heat-treated clarified lysate was incubated with 60 µL McIlvaine buffer pH 4. Residual activity was determined as described in Example 5. The results of this assay are shown in Table 8-1.

TABLE 8-1

Relative Activity of TAL Variants on Tyrosine Under Various Conditions (Relative to SEQ ID NO: 604)

| SEQ ID NO: (nt/aa) | Amino Acid Differences (Relative to SEQ ID NO: 604) | 2 mM Tyr FIOPC | Protease FIOPC | 0.1 mM Tyr FIOPC | pH 4 FIOPC |
|---|---|---|---|---|---|
| 615/616 | N531D | ++ | + | ++ | ++ |
| 617/618 | Q37A/K56G/S59A/H234Y/N531D | ++ | ++ | ++ | ++++ |
| 619/620 | A36V/H131M | + | + | ++ | ++++ |
| 621/622 | Q37A/K56G/S59A/R103L/E145V/H234Y/A328Q/Q471Y/N531D | ++ | ++ | ++ | ++++ |
| 623/624 | A36V/Q37A/H131M/E145V/H234Y/A328S | + | + | + | ++++ |
| 625/626 | A36V/Q37A/E145V/H234Y | + | ++ | ++ | ++++ |
| 627/628 | K56G/S59 A/R103L/Q471Y/N531D | + | + | ++ | +++ |
| 629/630 | A36V/S59A/H234Y/A328S |  | + | + | ++++ |
| 631/632 | Q37A/H234Y/Q471Y | + | ++ | ++ | ++++ |
| 633/634 | A36V/K56G/E145V/H234Y/A328S | + | ++ | ++ | ++++ |
| 635/636 | H234Y/N531D | ++ | + | ++ | ++++ |
| 637/638 | A36V/Q37A/R103L/H234Y | + | ++ | + | ++++ |
| 639/640 | H234Y/A328Q | ++ | ++ | ++ | ++++ |
| 641/642 | H234Y/A328S/Q471Y | + | ++ | ++ | ++++ |
| 643/644 | Q37A/K56G/H234Y/N531D | + | + | + | ++++ |
| 645/646 | A36V/R103L/E145V/A328S/N531D | + | ++ | ++ | ++++ |
| 647/648 | A36V/Q37A/H131M/N531D | ++ | + | ++ | ++++ |
| 649/650 | A36V/S59A/N531D | + | ++ | ++ | ++++ |
| 651/652 | K56G/S59A/Q471Y/N531D | ++ | ++ | ++ | +++ |
| 653/654 | Q37A/K56G/S59A/H234Y/A328S/R524L/N531D |  |  | + | ++++ |
| 655/656 | H234Y |  |  | + | ++++ |
| 657/658 | S59A/A328Q/R524L/N531D | ++ | + | ++ | ++++ |
| 659/660 | A36V/H234Y/N531D | + | + | ++ | ++++ |
| 661/662 | A36V/Q37A/K56G/S59A/E145V/H234Y/A328S | + | ++ | + | ++++ |
| 663/664 | Q37A/S59A/H234Y | + | + | + | ++++ |
| 665/666 | A36V/Q37A/H234Y/A328Q/N531D | + | + | ++ | ++++ |
| 667/668 | H131M/H234Y/A328Q | +++ |  | ++ | ++++ |
| 669/670 | A36V/Q37A/E145V/H234Y/A328S/Q471Y/N531D | + | + | ++ | ++++ |
| 671/672 | K518V/A519E/S548K/G549D | ++ | ++ | ++ | ++++ |
| 673/674 | L46T/T49D/A519E | +++ | ++ | ++ | ++ |
| 675/676 | L46R/H155L | ++ | ++ | ++ | + |
| 677/678 | K33N/L46T/K518V/A534S/S548K/G549D | ++ | ++ | ++ | ++++ |
| 679/680 | I336V/A519P | ++ | ++ | ++ | +++ |
| 681/682 | T49D/A519P | +++ | +++ | ++ | ++ |
| 683/684 | K33N/L46T/T49D/G549D | ++ | ++ | + | ++++ |
| 685/686 | S548K/G549D | + | + | ++ | ++++ |
| 687/688 | L46T/S548K | +++ | ++ | ++ | +++ |
| 689/690 | G549D | ++ | ++ | ++ | ++++ |
| 691/692 | K33N/T49D/I336V | +++ | +++ | ++ | +++ |
| 693/694 | K33N/L46T/T49D/I336V/A519E/S548K/G549D | ++ | ++ | + | ++++ |
| 695/696 | K33N/L46T/T49D | +++ | +++ | ++ | ++ |
| 697/698 | A519P | ++ | + | ++ | ++ |
| 699/700 | L46T/T49D/A519P | +++ | +++ | ++ | +++ |
| 701/702 | K33N/L46R/T49D/G549D | +++ | +++ | ++ | ++++ |
| 703/704 | K33N/L336V/A519P | ++ | ++ | ++ | +++ |
| 705/706 | L46R/T49D/K518V/A519E/S548K/G549D | ++ | ++ | ++ | ++++ |
| 707/708 | L46R/T49D | ++ | ++ | ++ | ++ |
| 709/710 | K33N/L46T/A519E | ++ | + | ++ | ++ |
| 711/712 | L541A |  |  | + | + |
| 713/714 | S521D | ++ | ++ | ++ | ++ |
| 715/716 | Q66R/A540R | ++ | + | ++ | +++ |
| 717/718 | E523D | + |  | + | + |
| 719/720 | P29E/Q66N/Q111K/A540R | ++ | ++ | ++ | + |
| 721/722 | Q111K | ++ | ++ | ++ | +++ |
| 723/724 | Q111K/E523A/N557E | ++ | ++ | ++ | ++ |
| 725/726 | P29E/Q111K | + | + | + |  |
| 727/728 | P29G/Q66N/Q111K | + | + | + |  |
| 729/730 | P29E/Q111K/E523D | + | + | + |  |
| 731/732 | Q111K/L510K/S521D/E523A/L541A/Q558D | ++ | + | ++ | +++ |
| 733/734 | F14S/S114P/E283D/R289Q | ++ | ++ | ++ | ++++ |
| 735/736 | F14S/K56R/S114P | ++ | ++ | ++ | ++++ |
| 737/738 | K56R/S114P/I291V | ++ | ++ | ++ | ++++ |
| 739/740 | F14S/S114P/K518Q | ++ | ++ | ++ | ++++ |
| 741/742 | K56R/S114P/E206Q/E283D | ++ | ++ | ++ | ++++ |
| 743/744 | F14S/E283D/R289Q/I562S | ++ | ++ | ++ | + |
| 745/746 | S114P/E283D/I291V | ++ | ++ | ++ | ++++ |
| 747/748 | K56R/S114P/I291V/K518Q/I562S | ++ | + | ++ | ++++ |
| 749/750 | S114P/I562S | ++ | ++ | ++ | ++++ |

TABLE 8-1-continued

Relative Activity of TAL Variants on Tyrosine Under
Various Conditions (Relative to SEQ ID NO: 604)

| SEQ ID NO: (nt/aa) | Amino Acid Differences (Relative to SEQ ID NO: 604) | 2 mM Tyr FIOPC | Protease FIOPC | 0.1 mM Tyr FIOPC | pH 4 FIOPC |
|---|---|---|---|---|---|
| 751/752 | K56R/S114P/K518Q | +++ | ++ | ++ | ++++ |
| 753/754 | F14S/S114P/E283S/R289Q/I562S | ++ | ++ | ++ | ++++ |
| 755/756 | S114P/E283D/R289Q/Q305E/K518Q | +++ | ++ | ++ | ++++ |
| 757/758 | S114P/R289Q/I562S | ++ | ++ | ++ | ++++ |
| 759/760 | S114P/K518Q/I562S | ++ | ++ | ++ | ++++ |
| 761/762 | F14S/S114P/E283D/R289Q/I291V | ++ | ++ | ++ | ++++ |
| 763/764 | S114P/I291V/K518Q | ++ | ++ | ++ | ++++ |
| 765/766 | F14S/H234L/E283D/I291V/Q305E | ++ | ++ | ++ | ++++ |
| 767/768 | K56R/K518Q | ++ | ++ | ++ | + |
| 769/770 | S114P/E283D/R289Q/I291V | ++ | ++ | ++ | ++++ |
| 771/772 | S114P/I291V | ++ | + | ++ | ++++ |
| 773/774 | S114P/R289Q | ++ | ++ | ++ | ++++ |
| 775/776 | S114P | ++ | ++ | ++ | ++++ |
| 777/778 | F14S/S114P/I291V/K518Q/I562S | ++ | + | ++ | ++++ |
| 779/780 | Q305E | ++ | ++ | ++ | + |
| 781/782 | S114P/E206P/E283S/R289Q/I562S | ++ | ++ | ++ | ++++ |
| 783/784 | K56R | ++ | ++ | ++ | ++ |
| 785/786 | R289Q/I562S | ++ | ++ | ++ | ++ |

[1]All activities were determined relative to reference polypeptide SEQ ID NO: 604. Levels of increased activity are defined as follows: "+" = 0.9 to 1.2; "++" > 1.2; "+++" > 2; and "++++" > 3.

Example 9

TAL Variants of SEQ ID NO: 736

In this Example, experiments for evolution and screening of TAL variants derived from SEQ ID NO: 736 for improved tyrosine activity, protease resistance, and low pH tolerance are described. Directed evolution of the TAL encoded by SEQ ID NO: 735, was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4 with the following conditions: 20 μL of HTP lysate diluted 10-fold in water was assayed with 2.2 mM tyrosine for 5 min and 10 μL of undiluted HTP lysate was assayed with 0.1 mM tyrosine for 5 min. The results of the assays are shown in Tables 9.1 and 9.2. SEQ ID NO: 790 was selected for further directed evolution.

HTP Activity Analysis of Clarified Lysates Pretreated with Protease

TAL variants were challenged with chymotrypsin and trypsin as described in Example 7, and residual activity was determined as described in Example 6. The results of this assay are shown in Tables 9-1 and 9-2.

HTP Activity Analysis of Clarified Lysates Pretreated with Acidic Buffer

TAL variants were challenged with acidic buffer as described in Example 8, and residual activity was determined as described in Example 7. The results of this assay are shown in Tables 9-1 and 9-2.

TABLE 9-1

Relative Activity of TAL Variants on Tyrosine Under
Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | pH 4 FIOPC |
|---|---|---|---|---|
| 787/788 | G549D | + | + | ++ |
| 789/790 | T49D/S59A/R289Q/I562S | + | ++ | + |
| 791/792 | S59A/E145V/H234Y/I291V | + | + | ++ |
| 793/794 | T49D/S59A/Q66N/R289Q | + | ++ | + |
| 795/796 | R56G/H234Y/I291V | | + | + |
| 797/798 | R56G/S59A/Q111K/H234Y/N531D | + | + | ++ |
| 799/800 | T49D/Q111K/N531D | + | + | + |
| 801/802 | Q111K/I291V | + | | + |
| 803/804 | K518Q/N531D/G549D/I562S | + | + | ++ |
| 805/806 | R56G/S59A/E145V/R289Q/K518Q/I562S | ++ | ++ | + |
| 807/808 | I291V/K518Q/G549D | + | | ++ |
| 809/810 | R56G/S59A/H234Y | + | ++ | ++ |
| 811/812 | R56G/Q111K/E145V/H234Y/R289Q/N531D/I562S | + | + | ++ |
| 813/814 | K518Q | + | + | + |
| 815/816 | Q111K/E145V | + | | ++ |
| 817/818 | T49D/R56G/Q66N/H234Y | + | ++ | + |
| 819/820 | H234Y | + | + | ++ |

TABLE 9-1-continued

Relative Activity of TAL Variants on Tyrosine Under Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | pH 4 FIOPC |
|---|---|---|---|---|
| 821/822 | T49D/R56G/Q66N/Q111K/H234Y/I291V/K518Q | + | + | + |
| 823/824 | T49D/R56G/S59A/Q66N/I291V/N531D/G549D | + | + | ++ |
| 825/826 | Q111K/E145V/H234Y/I291V/I562S | + | + | ++ |
| 827/828 | Q111K/E145V/H234Y/I562S | + | + | ++ |
| 829/830 | T49D/R56G/S59A/Q111K/G549D | + | ++ | ++ |
| 831/832 | Q111K/R289Q | + | + | ++ |
| 833/834 | S59A | + | + | ++ |
| 835/836 | R56G/Q111K/K518Q/G549D | + | + | + |
| 837/838 | T49D/Q66N/Q111K/H234Y/I291V/K518Q/I562S | + | + | ++ |
| 839/840 | N531D | + | + | + |
| 841/842 | R56G/S59A/Q111K/I291V/K518Q/N531D | + |  | + |
| 843/844 | R56G/S59A/Q111K/E283D/K518Q/N531D | + | + | + |
| 845/846 | T49D/H234Y | + | + | ++ |
| 847/848 | S59A/H234Y/I291V | + | + | ++ |
| 849/850 | Q111K/H234Y | + | + | ++ |
| 851/852 | D20G/S59A/H234Y/K518Q/G549D/I562S |  | + | ++ |
| 853/854 | R56G/S59A/K518Q | + | + | + |
| 855/856 | R56G/S59A/Q111K/H234Y/R289Q | + | ++ | ++ |
| 857/858 | D20G/T49D/R56G/S59A/Q111K/I291V |  | + |  |
| 859/860 | S59A/H234Y/I291V/I387T/G549D/I562S | + |  | + |
| 861/862 | T49D/S59A/Q66N/E145V/H234Y | + |  |  |
| 863/864 | Q111K/K518Q | + | + | + |
| 865/866 | H234Y/K518Q/G549D | + | + | ++ |
| 867/868 | S59A/Q111K/ | + | + | ++ |
| 869/870 | R56G/Q111K/E145V/H234Y/K518Q/G549D/I562S | + | + | ++ |
| 871/872 | R56G/S59A/H234Y/K518Q | + | + | ++ |
| 873/874 | R56G/S59A/Q111K/I291V | + | + | + |

[1] All activities were determined relative to reference polypeptide SEQ ID NO: 736. Levels of increased activity are defined as follows: "+" = 0.9 to 1.2; "++" > 1.2; "+++" > 2; and "++++" > 3.

TABLE 9-2

Relative Activity of TAL Variants on Tyrosine Under Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | 0.1 mM Tyr FIOPC | pH 4 FIOPC |
|---|---|---|---|---|---|
| 875/876 | K33N/Q37A/K518V/S521D/S548K | ++ | ++ | ++ | ++ |
| 877/878 | Q37A/R103L/Q305E/I336V/E523D/A540R | ++ | ++ | ++ | +++ |
| 879/880 | K33N/L46R/E523D | ++ | ++ | ++ | ++ |
| 881/882 | Q37A/R103L/Q305E/S521D/L541A/S548K | ++ | ++ | ++ | +++ |
| 883/884 | Q37A/Q305E/I336V/A540R/S548K | ++ | + | ++ | +++ |
| 885/886 | L46R/R103L/Q305E/S548K | ++ | + | ++ | +++ |
| 887/888 | Q37A/R103L/L541A/S548K | ++ | ++ | ++ | +++ |
| 889/890 | Q37A/I336V/A540R | ++ | ++ | ++ | +++ |
| 891/892 | Q37A/S548K | ++ | ++ | ++ | ++ |
| 893/894 | K33N/L46R/I336V/S521D/E523D | ++ | ++ | ++ | ++ |
| 895/896 | K33N/Q37A/E523D/A540R/S548K | ++ | ++ | ++ | +++ |
| 897/898 | L46R/R103L/Q305E/Q471Y/A540R/S548K | ++ | + | ++ | +++ |
| 899/900 | E523D | ++ | ++ |  | ++ |
| 901/902 | K33N/L46R/K518V/S521D/S548K | ++ | ++ |  | ++ |
| 903/904 | K33N/Q37A/I336V/A540R/S548K | ++ | ++ | ++ | +++ |
| 905/906 | L46R/Q305E/E523D/S548K | ++ | + | ++ | ++ |
| 907/908 | K33N/L46R | ++ | ++ | ++ | ++ |
| 909/910 | Q37A/L541A | + | ++ | + | ++ |
| 911/912 | K33N/L46R/Q305E/I336V | ++ | ++ | ++ | ++ |
| 913/914 | L46R/Q305E/I336V/K522E | ++ | + | ++ | ++ |
| 915/916 | L46R/R103L/Q305E | ++ | + | ++ | +++ |
| 917/918 | K33N/Q37A/Q305E/A328Q/S548K | ++ | ++ | ++ | +++ |
| 919/920 | L46R/Q305E/Q471Y | ++ | + | ++ | ++ |
| 921/922 | Q37A/Q305E/E523D/L541A/S548K | ++ | + | ++ | +++ |
| 923/924 | Q37A/Q305E/L541A/S548K | ++ | + | ++ | ++ |
| 925/926 | L46R/I336V/E523D/S548K | ++ | ++ | ++ | ++ |
| 927/928 | K33N/Q37A/R103L/A519P/E523D | ++ | ++ | ++ | +++ |
| 929/930 | K33N/L46R/S548K | ++ | ++ | ++ | ++ |

TABLE 9-2-continued

Relative Activity of TAL Variants on Tyrosine Under
Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | 0.1 mM Tyr FIOPC | pH 4 FIOPC |
|---|---|---|---|---|---|
| 931/932 | K33N/L46R/L541A | ++ | ++ | ++ | ++ |
| 933/934 | Q37A/Q305E/Q471Y/A540R/S548K | ++ | + | ++ | ++ |
| 935/936 | Q37A/E523D/L541A | ++ | ++ | ++ | ++ |
| 937/938 | Q37A/I336V/Q471Y/L541A/S548K | + | ++ | ++ | ++ |
| 939/940 | K33N/L46R/R103L/Q305E/A540R | ++ | ++ | ++ | +++ |
| 941/942 | K33N/Q37A/R103L/K518V/E523D/L541A | ++ | ++ | ++ | ++ |
| 943/944 | K33N/Q37A/Q471Y/E523D/A540R/S548K | ++ | ++ | ++ | ++ |
| 945/946 | K33N/Q37A/R103L/Q471Y/A519P/S548K | ++ | ++ | ++ | +++ |
| 947/948 | L46R/R103L/Q305E/I336V/E523D | + | + | ++ | +++ |
| 949/950 | Q37A/Q471Y/S521D/A540R/S548K | ++ | ++ | ++ | ++ |
| 951/952 | K33N/Q37A/S548K | ++ | ++ | ++ | ++ |
| 953/954 | Q37A/S521D/E523D/S548K | ++ | ++ | ++ | ++ |
| 955/956 | K33N/L46R/I336V/S521D | + | ++ | + | ++ |
| 957/958 | L46R/I336V/A540R/S548K | ++ | ++ | ++ | ++ |
| 959/960 | Q37A/Q305E/I336V/E523D/S548K | ++ | + | ++ | +++ |
| 961/962 | K33N/Q37A/Q305E/I336V/S521D/S548K | ++ | ++ | ++ | +++ |
| 963/964 | Q37A/Q305E/I336V/S521D/A540R/S548K | ++ | ++ | ++ | +++ |
| 965/966 | K33N/Q37A/Q305E/A540R | ++ | ++ | ++ | +++ |
| 967/968 | Q37A/Q305E/S548K | ++ | ++ | ++ | +++ |
| 969/970 | Q37A/Q305E/Q471Y/E523D/A540R/S548K | ++ | + | ++ | ++ |
| 971/972 | K33N/Q37A/R103L/Q305E | ++ | ++ | ++ | +++ |
| 973/974 | K33N/Q37A/I336V/A540R | ++ | ++ | ++ | +++ |
| 975/976 | K33N/Q37A/K518V/S521D/A540R | ++ | ++ | ++ | ++ |
| 977/978 | K33N/Q37A/I336V | ++ | ++ | ++ | ++ |
| 979/980 | K33N/Q37A/Q305E/A328Q | ++ | ++ | ++ | ++ |
| 981/982 | Q37A/A540R/S548K | ++ | ++ | ++ | ++ |
| 983/984 | Q37A/I336V/S548K | ++ | ++ | ++ | ++ |
| 985/986 | L46R/R103L/L541A/S548K | ++ | ++ | ++ | +++ |
| 987/988 | K33N/Q37A | ++ | ++ | ++ | ++ |
| 989/990 | Q37A/R103L/A519P/L541A/S548K | ++ | ++ | ++ | +++ |
| 991/992 | Q37A/R103L/A328Q/S521D/L541A/S548K | ++ | ++ | ++ | +++ |
| 993/994 | L46R/S521D/E523D | ++ | ++ | ++ | ++ |
| 995/996 | K33N/Q37A/R103L/Q305E/E523D/S548K | ++ | ++ | ++ | +++ |
| 997/998 | L46R/R103L/Q305E/P520Q/A540R | ++ | + | ++ | +++ |
| 999/1000 | L46R/Q305E/I336V/K518V | ++ | + | ++ | ++ |
| 1001/1002 | K33N/Q37A/R103L/Q305E/S548K | ++ | + | ++ | +++ |
| 1003/1004 | Q37A/A519P | ++ | ++ | ++ | ++ |
| 1005/1006 | Q37A/Q471Y | ++ | ++ | ++ | ++ |
| 1007/1008 | L46R/Q305E | ++ | + | ++ | ++ |
| 1009/1010 | R103L | ++ | ++ | ++ | +++ |
| 1011/1012 | L46R/E523D/L541A/S548K | ++ | ++ | ++ | ++ |
| 1013/1014 | K33N/Q37A/K518V/S548K | ++ | ++ | ++ | ++ |
| 1015/1016 | Q37A/Q471Y/K518V | ++ | ++ | ++ | ++ |
| 1017/1018 | K33N/L46R/R103L/A540R/S548K | ++ | ++ | ++ | +++ |
| 1019/1020 | Q37A/S521D/A540R | ++ | ++ | ++ | ++ |
| 1021/1022 | K33N/L46R/R103L/Q305E/I336V/S548K | ++ | + | ++ | +++ |
| 1023/1024 | L46R/Q305E/S548K | ++ | ++ | ++ | ++ |
| 1025/1026 | Q37A/Q305E/A519P/S548K | ++ | + | ++ | ++ |
| 1027/1028 | Q37A/I336V/S521D/E523D/S548K | ++ | ++ | ++ | +++ |
| 1029/1030 | Q37A/E523D/S548K | ++ | ++ | ++ | ++ |
| 1031/1032 | K33N/Q37A/R103L/Q305E/I336V/L541A/S548K | ++ | ++ | ++ | ++++ |
| 1033/1034 | Q37A/R103L/Q305E/Q471Y/A540R/S548K | ++ | ++ | ++ | +++ |
| 1035/1036 | K33N/Q37A/Q305E/L541A | ++ | ++ | ++ | ++ |
| 1037/1038 | Q37A/Q305E/I336V | ++ | ++ | ++ | +++ |
| 1039/1040 | Q37A/Q305E/S521D/A540R | ++ | + | ++ | ++ |
| 1041/1042 | S521D/S548K | ++ | + | ++ | ++ |
| 1043/1044 | K33N/Q37A/R103L/A540R | ++ | ++ | ++ | +++ |
| 1045/1046 | R103L/S521D/E523D/A540R | + | ++ | + | +++ |
| 1047/1048 | K33N/L46R/I336V/A540R/S548K | ++ | ++ | ++ | +++ |
| 1049/1050 | Q37A/I336V | ++ | ++ | ++ | ++ |
| 1051/1052 | K33N/Q37A/Q305E/Q471Y/S521D/S548K | ++ | ++ | ++ | ++ |
| 1053/1054 | K33N/L46R/Q305E | ++ | + | ++ | ++ |
| 1055/1056 | Q37A/R103L/A328Q/I336V/K518V/E523D/S548K | ++ | ++ | ++ | +++ |
| 1057/1058 | L46R/R103L/Q305E/I336V/Q471Y/A540R/S548K | ++ | ++ | ++ | +++ |
| 1059/1060 | K33N/L46R/R103L/Q305E/I336V/K518V/A519P/A540R | ++ | ++ | ++ | +++ |
| 1061/1062 | L46R/S548K | ++ | ++ | ++ | ++ |
| 1063/1064 | Q37A/R103L | ++ | ++ | + | +++ |
| 1065/1066 | Q37A/R103L/Q305E/Q471Y | ++ | ++ | ++ | +++ |
| 1067/1068 | K33N/L46R/I336V/A540R | ++ | ++ | ++ | +++ |

TABLE 9-2-continued

Relative Activity of TAL Variants on Tyrosine Under
Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | 0.1 mM Tyr FIOPC | pH 4 FIOPC |
|---|---|---|---|---|---|
| 1069/1070 | Q37A/Q305E/L541A | ++ | + |  | ++ |
| 1071/1072 | L46R/Q305E/I336V/S548K | ++ | + | ++ | ++ |
| 1073/1074 | K33N/Q37A/S521D/S548K | ++ | ++ | ++ | ++ |
| 1075/1076 | Q37A | ++ | ++ | ++ | ++ |
| 1077/1078 | K33N/Q37A/Q305E/E523D/A540R | ++ | ++ | ++ | +++ |
| 1079/1080 | L46R/Q305E/I336V | ++ | + | ++ | ++ |
| 1081/1082 | K33N/Q37A/R103L/I336V/K518V/L541A/S548K | ++ | ++ | ++ | +++ |
| 1083/1084 | L46R | ++ | ++ | ++ | ++ |
| 1085/1086 | K33N/Q37A/A540R | ++ | ++ | ++ | +++ |
| 1087/1088 | Q37A/R103L/A540R | ++ | ++ | ++ | +++ |
| 1089/1090 | K33N/Q37A/Q305E | ++ | ++ | ++ | ++ |
| 1091/1092 | Q37A/R103L/I336V/S521D/L541A | + | ++ | + | +++ |
| 1093/1094 | K33N/L46R/Q66K/Q305E/S521D/E523D/A540R/S548K |  | + | ++ | +++ |
| 1095/1096 | K33N/Q37A/E523D | ++ | ++ | ++ | ++ |
| 1097/1098 | L46R/E523D/A540R | ++ | ++ | ++ | ++ |
| 1099/1100 | Q37A/R103L/Q305E/A540R | ++ | ++ | ++ | +++ |
| 1101/1102 | K33N/Q37A/R103L | ++ | ++ | ++ | +++ |
| 1103/1104 | L46R/S521D/S548K | ++ | ++ | ++ | ++ |
| 1105/1106 | Q37A/I336V/S521D/E523D | ++ | ++ | ++ | ++ |
| 1107/1108 | L46R/R103L/S548K | ++ | ++ | ++ | +++ |
| 1109/1110 | Q37A/R103L/I336V | ++ | ++ | ++ | +++ |
| 1111/1112 | L46R/L541A/S548K | ++ | ++ | + | ++ |
| 1113/1114 | Q37A/Q305E | ++ | ++ | ++ | ++ |
| 1115/1116 | Q37A/R103L/Q305E/I336V/S521D/E523D/A540R/S548K | ++ | + | ++ | +++ |
| 1117/1118 | K33N/L46R/Q305E/K518V/A540R/S548K | ++ | + | ++ | ++ |
| 1119/1120 | L46R/I336V/S521D/E523D | ++ | ++ | ++ | ++ |
| 1121/1122 | K33N/Q37A/Q305E/I336V/S521D/E523D/S548K | ++ | ++ | ++ | ++ |
| 1123/1124 | Q305E/I336V/L541A/S548K | ++ | + | ++ | ++ |
| 1125/1126 | L46R/R103L/E523D/S548K | ++ | ++ | ++ | ++ |
| 1127/1128 | Q37A/Q305E/I336V/L541A/S548K | ++ | + | ++ | ++ |
| 1129/1130 | Q37A/R103L/Q305E/I336V | ++ | + | ++ | +++ |
| 1131/1132 | K33N/Q37A/Q305E/I336V/K518V/E523D | ++ | + | ++ | ++ |
| 1133/1134 | L46R/R103L/L541A | ++ | ++ | + | +++ |
| 1135/1136 | I336V/S548K | + | ++ | + | ++ |
| 1137/1138 | R103L/I336V/S548K | ++ | ++ | + | +++ |
| 1139/1140 | Q37A/Q471Y/K518V/A519P/E523D | ++ | ++ | ++ | ++ |
| 1141/1142 | A519P/S548K | + | + | + | ++ |
| 1143/1144 | K33N/Q37A/Q305E/I336V/Q471Y/L541A | ++ | ++ | ++ | ++ |
| 1145/1146 | K33N/Q37A/L46R/Q305E | ++ | + | ++ | ++ |
| 1147/1148 | Q37A/Q305E/S521D/E523D/A540R/S548K | ++ | + | ++ | ++ |
| 1149/1150 | K33N/L46R/S521D/S548K | ++ | ++ | ++ | ++ |
| 1151/1152 | Q37A/Q305E/Q471Y | ++ | + | ++ | ++ |
| 1153/1154 | Q37A/I336V/E523D/S548K | + | + | + | ++ |
| 1155/1156 | Q37A/Q305E/S521D/L541A/S548K | ++ | + | ++ | ++ |
| 1157/1158 | K33N/R103L/I336V/K518V/S521D/S548K | ++ | ++ | ++ | ++ |
| 1159/1160 | K33N/Q37A/Q305E/I336V/L541A | ++ | + | ++ | ++ |
| 1161/1162 | K33N/Q471Y/E523D/L541A | ++ | ++ | ++ | ++ |
| 1163/1164 | L46R/R103L/A540R/S548K | + | + | + | ++ |
| 1165/1166 | K33N/Q37A/R103L/E523D | + | ++ | + | ++ |
| 1167/1168 | L46R/I336V/A540R | ++ | ++ | ++ | ++ |
| 1169/1170 | L46R/S521D/E523D/A540R | ++ | ++ | ++ | ++ |
| 1171/1172 | L46R/L541A | ++ | ++ | ++ | + |
| 1173/1174 | K33N/L46R/I336V/Q471Y/A519P/E523D/S548K | ++ | ++ | ++ | ++ |
| 1175/1176 | Q37A/A540R | ++ | ++ | ++ | ++ |
| 1177/1178 | L46R/T49D/N531D/G549D | + | + | + | ++ |
| 1179/1180 | R289Q/S521D/E523D | + | + | + |  |
| 1181/1182 | H234Y/R289Q/E523D/N531D/G549D/I562S | + | + | + | +++ |
| 1183/1184 | R289Q | + | + | + | + |
| 1185/1186 | S521D | + | + | + | + |
| 1187/1188 | L46R/T49D/Q111K/H234Y/I336V | + | + | + | +++ |
| 1189/1190 | L46R/T49D/Q111K/H234Y/R289Q/L436V/G549D | + | + | + | ++ |
| 1191/1192 | L46R/T49D/H234Y/G549D | + | + | + | +++ |
| 1193/1194 | T49D | + | + | + |  |
| 1195/1196 | T49D/R289Q/Q305E/I336V/E523D | + | + | + |  |
| 1197/1198 | T49D/Q111K/H234Y/R289Q/I336V/E523D/N531D/G549D | + | + | + | ++ |

TABLE 9-2-continued

Relative Activity of TAL Variants on Tyrosine Under Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | 0.1 mM Tyr FIOPC | pH 4 FIOPC |
|---|---|---|---|---|---|
| 1199/1200 | S59A/G549D | + | + | + | +++ |
| 1201/1202 | T49D/S59A/H234Y/R289Q/I336V/E523D/N531D/G549D | + | + |  | ++ |
| 1203/1204 | L46R/H234Y/R289Q/G549S | + | + | + | +++ |
| 1205/1206 | T49D/H234Y/R289Q/E523D | + | + | + | ++ |
| 1207/1208 | S59A/Q111K/R289Q | + | + | + | +++ |
| 1209/1210 | R289Q/I336V/G549D | + | + | + | ++ |
| 1211/1212 | T49D/Q111K/H234Y | + | + | + | +++ |
| 1213/1214 | T49D/H234Y/Q305E/G549D | + | + | + | +++ |
| 1215/1216 | H234Y/S521D/E523D/G549D | + | + |  | ++ |
| 1217/1218 | L46R/T49D/R289Q/E523D/N531D/G549D/I562S | + | + | + | ++ |
| 1219/1220 | T49D/Q111K/E523D/N531D/G549D | ++ | + | + | ++ |
| 1221/1222 | T49D/H234Y/G549D | + | ++ | + | +++ |
| 1223/1224 | T49D/H234Y/R289Q | + | ++ | + | ++ |
| 1225/1226 | L46R/Q111K/H234Y/R289Q/N531D/G549D | + | + | + | +++ |
| 1227/1228 | Q111K/R289Q/I336V/S521D | + | + | + | ++ |
| 1229/1230 | T49D/H234Y | + | ++ | + | ++ |
| 1231/1232 | T49D/E523D/G549D | + | ++ | + | ++ |
| 1233/1234 | L46R/T49D/Q111K/H234Y/I336V/E523D/G549D | + | ++ | + | +++ |
| 1235/1236 | T49D/Q111K/R289Q | + | ++ | + | + |
| 1237/1238 | T49D/S59A/Q111K/R289Q/E523D | + | ++ | + | ++ |
| 1239/1240 | H234Y/I562S | + | + | + | ++ |
| 1241/1242 | S59A/Q111K/H234Y/R289Q/Q305E/I336V/G549D | + | + | + | ++++ |
| 1243/1244 | L46R/S59A/G549D/I562S/ | + | ++ | + | +++ |
| 1245/1246 | T49D/Q111K/H234Y/I336V/S521D/E523D | + | + | + | ++ |
| 1247/1248 | H234Y/R289Q/N531D | + | + | + | ++ |
| 1249/1250 | H234Y/G549D | + | + | + | +++ |
| 1251/1252 | H234Y/R289Q/G549D | + | + | + | +++ |
| 1253/1254 | T49D/Q111K/H234Y/R289Q/S521D/E523D/N531D/G549D/I562S | + | + | + | ++ |
| 1255/1256 | H234Y/A540R | + | + | + | +++ |
| 1257/1258 | T49D/Q111K/H234Y/I336V/E523D/N531D | + | + | + | ++ |
| 1259/1260 | H234Y/R289Q | + | + | + | ++ |
| 1261/1262 | T49D/S521D/G549D | + | ++ | + | ++ |
| 1263/1264 | R289Q/S521D/E523D/G549D | + | + | + | +++ |
| 1265/1266 | T49D/S59A/Q111K/H234Y/R289Q/S521D | + | ++ | + | +++ |
| 1267/1268 | T49D/R289Q/I336V/S521D/N531D | + | + | + |  |
| 1269/1270 | T49D/S59A/S521D/N531D | + | + | + | ++ |
| 1271/1272 | Q111K/H234Y/R289Q | + | + | + | +++ |
| 1273/1274 | L46R/R289Q/G549D | + | + | + | +++ |
| 1275/1276 | T49D/S59A/H234Y/R289Q/I336V | + | + | + | ++ |
| 1277/1278 | H234Y/I336V/N531D/I562S | + | + | + | +++ |
| 1279/1280 | T49D/I336V/S521D/I562S | + | + | + | + |
| 1281/1282 | L46R/Q111K/H234Y/S521D/G549D | + | + | + | +++ |
| 1283/1284 | Q111K/S521D/E523D/G549D | + | + | + | +++ |
| 1285/1286 | L46R/T49D/H234Y/I336V/S521D/E523D/G549D | + | + | + | +++ |
| 1287/1288 | T49D/S59A/I336V | + | + | + | ++ |
| 1289/1290 | S521D/I562S | + | + | + | + |
| 1291/1292 | H234Y/R289Q/E523D/G549D | + | + | + | +++ |
| 1293/1294 | L46R/T49D/H234Y/R289Q/I336V | + | + | + | ++ |
| 1295/1296 | T49D/S521D/N531D/G549D/I562S | + | + | + | ++ |
| 1297/1298 | T49D/Q111K/H234Y/G549D | + | ++ | + | +++ |
| 1299/1300 | S59A/Q111K/I336V | + | + | + | +++ |
| 1301/1302 | L46R/T49D/S59A/Q111K/E523D/N531D/G549D | + | + | + | +++ |
| 1303/1304 | L46R/T49D/Q111K/I336V/G549D | + | + | + | +++ |
| 1305/1306 | T49D/H234Y/R289Q/I336V/N531D/G549D | + | + | + | ++ |
| 1307/1308 | Q111K/H234Y/R289Q/E523D | + | + | + | +++ |
| 1309/1310 | L46R/T49D/Q111K/H234Y/R289Q/N531D/G549D | + | + | + | +++ |
| 1311/1312 | L46R/H234Y/G549D | + | + | + | +++ |
| 1313/1314 | S59A | + | + | + | ++ |
| 1315/1316 | T49D/H234Y/R289Q/E523D/N531D/A540R | + | + | + | ++ |
| 1317/1318 | T49D/S59A/R289Q/I336V | + | ++ | + | ++ |
| 1319/1320 | T49D/Q111K/H234Y/R289Q/E523D/G549D | + | ++ | + | ++ |
| 1321/1322 | L46R | + | + | + | + |
| 1323/1324 | R289Q/S521D/E523D/A540R | + | + | + | + |

TABLE 9-2-continued

Relative Activity of TAL Variants on Tyrosine Under
Various Conditions (Relative to SEQ ID NO: 736)[1]

| SEQ ID NO: (nt/aa) | Amino Acid Differences (Relative to SEQ ID NO: 736) | 2 mM Tyr FIOPC | Protease FIOPC | 0.1 mM Tyr FIOPC | pH 4 FIOPC |
|---|---|---|---|---|---|
| 1325/1326 | G549D | + | + | + | ++ |
| 1327/1328 | L46R/Q111K/E523D/N531D/G549D | + | + | + | ++ |
| 1329/1330 | T49D/S59A/R289Q/Q305E/I336V | ++ | + | + | ++ |
| 1331/1332 | L46R/S59A/H234Y | + | + | + | +++ |
| 1333/1334 | T49D/G549D | + | ++ | + | ++ |
| 1335/1336 | H234Y/N531D/G549D | + | + | + | +++ |
| 1337/1338 | T49D/Q111K/H234Y/E523D/N531D/G549D | + | + | + | +++ |
| 1339/1340 | T49D/R289Q/I336V | + | + | + | |
| 1341/1342 | S59A/Q111K/H234Y/R289Q/Q305E/G549D | + | + | + | ++++ |
| 1343/1344 | N531D/G549D | + | + | + | ++ |
| 1345/1346 | Q111K/R289Q/I336V/E523D/G549D | + | + | + | +++ |
| 1347/1348 | H234Y/R289Q/I336V/E523D | + | + | + | ++ |
| 1349/1350 | H234Y/I336V | + | + | + | ++ |
| 1351/1352 | A540R | + | + | + | + |
| 1353/1354 | T49D/Q111K/H234Y/N531D | + | + | + | ++ |
| 1355/1356 | H234Y | + | + | + | ++ |
| 1357/1358 | T49D/Q111K | + | + | + | + |
| 1359/1360 | T49D/Q111K/N531D/G549D | + | + | + | ++ |
| 1361/1362 | L46R/G549D | + | + | + | ++ |
| 1363/1364 | Q111K/I336V/I562S | + | ++ | + | ++ |
| 1365/1366 | H234Y/E523D/N531D | + | + | + | ++ |
| 1367/1368 | T49D/H234Y/R289Q/E523D/G549D | + | ++ | + | ++ |
| 1369/1370 | T49D/Q111K/R289Q/I336V/S521D/G549D | + | ++ | + | ++ |
| 1371/1372 | T49D/H234Y/S521D | + | + | + | ++ |
| 1373/1374 | L46R/T49D/H234Y/A540R/G549D | + | + | + | +++ |
| 1375/1376 | L46R/S521D/E523D/G549D | + | + | + | ++ |
| 1377/1378 | S521D/G549D | + | + | + | ++ |
| 1379/1380 | L46R/H234Y/S521D/E523D/N531D/A540R/G549D | + | + | + | +++ |
| 1381/1382 | R289Q/E523D | + | + | + | + |
| 1383/1384 | H234Y/S521D/E523D | + | + | + | ++ |

[1]All activities were determined relative to reference polypeptide SEQ ID NO: 736. Levels of increased activity are defined as follows: "+" = 0.9 to 1.2; "++" > 1.2; "+++" > 2; and "++++" > 3.

Example 10

TAL Variants of SEQ ID NO: 790

In this Example, experiments for evolution and screening of TAL variants derived from SEQ ID NO: 790 for improved tyrosine activity, protease resistance, and low pH tolerance are described. Directed evolution of the TAL encoded by SEQ ID NO: 790 was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4 with the following conditions: 20 µL of HTP lysate diluted 10-fold in water was assayed with 2.2 mM tyrosine for 5 min. The results of the assays are shown in Tables 10-1 and 10-2. SEQ ID NO: 1454 was selected for further directed evolution.

HTP Activity Analysis of Clarified Lysates Pretreated with Protease and/or Acidic Buffer TAL variants were challenged with chymotrypsin and trypsin, whereby 50 µL of HTP lysate diluted 2-fold was incubated with 50 µL 4 g/L protease mix for 2 h at 37° C. in a THERMOTRON® (INFORS) titre-plate shaker (400 rpm). Protease mix consisted of 4 mg/mL chymotrypsin (Sigma Aldrich) and 4 mg/mL trypsin (Sigma Aldrich) in 100 mM sodium phosphate pH 8.0. Residual activity was determined by adding 40 µL of the protease-treated lysate to 160 µL of 200 mM sodium phosphate, 2.5 mM tyrosine, pH 7.0, in a 96-well UV-STAR® plate (Greiner Bio-One). The reactions were mixed briefly, and activity was determined as described in Example 4. The results of this assay are shown in Tables 10-1 and 10-2.

TAL variants were challenged with acidic buffer, whereby 90 µL of heat-treated clarified lysate was incubated with 90 µL McIlvaine buffer pH 4 for 1-2 h at 37° C. in a THERMOTRON® (INFORS) titre-plate shaker (400 rpm). After incubation, the lysate solutions were briefly centrifuged, and residual activity was determined by adding 20 µL of the acidic buffer-treated lysate to 180 µL of 200 mM sodium phosphate, 2.5 mM tyrosine, pH 7.0, in a 96-well UV-STAR® plate (Greiner Bio-One). The reactions were mixed briefly, and activity was determined as described in Example 4. The results of this assay are shown in Tables 10-1 and 10-2.

In some instances, the acidic buffer-treated lysate described above was further challenged with protease in a combined pH and protease assay. After pretreatment with acidic buffer, the lysate solutions were briefly centrifuged, and 75 µL of the supernatant was incubated with 75 µL 4 g/L protease mix dissolved in 200 mM sodium phosphate dibasic for 2 h at 37° C. in a THERMOTRON® (INFORS) titre-plate shaker (400 rpm). Residual activity was determined by adding 40 µL of the pretreated lysate to 160 µL of 200 mM sodium phosphate, 2.5 mM tyrosine, pH 7.0, in a 96-well UV-STAR® plate (Greiner Bio-One). The reactions were mixed briefly, and activity was determined as described in Example 4. The results of this assay are shown in Table 10-1.

TABLE 10-1

Relative Activity of TAL Variants on Tyrosine under various conditions (Relative to SEQ ID NO: 790)[1]

| SEQ ID NO: (nt/aa) | Amino Acid Differences (Relative to SEQ ID NO: 790) | 2 mM Tyr FIOPC | Protease FIOPC | pH 4 FIOPC | Combined pH and Protease FIOPC |
|---|---|---|---|---|---|
| 1385/1386 | L202R/K332Q/D408E | ++ | ++ | ++ | + |
| 1387/1388 | K44R | + | + | + | + |
| 1389/1390 | D408E | ++ | ++ | + | + |
| 1391/1392 | I24T/L202R/G351N | + | ++ | + | ++ |
| 1393/1394 | I24T/K44R/R464Q | + | ++ | + | + |
| 1395/1396 | I24T/K201N/L202R/G351N/Q507R | + | ++ | + | ++ |
| 1397/1398 | L202R | + | ++ | + | + |
| 1399/1400 | K33N/Q37A/Q111K/S548K | + | ++ | + | + |
| 1401/1402 | K33N/R56G/R103L/Q111K | + | ++ | + | + |
| 1403/1404 | L46R/I336V/A540R/G549D | + | ++ | ++ | ++ |
| 1405/1406 | K33N/I336V/G549D | + | ++ | + | + |
| 1407/1408 | K33N/I336V/A540R/S548K | + | + | + | + |
| 1409/1410 | K33N/Q37A/L46R/R103L/Q111K/H234Y | + | ++ | ++ | ++ |
| 1411/1412 | Q37A/L46R/R56G/E523D | + | ++ | + | + |
| 1413/1414 | K33N/I336V | + | ++ | + | + |
| 1415/1416 | K33N/Q37A/E523D/A540R/S548K | ++ | ++ | + | + |
| 1417/1418 | K33N/Q37A/L46R/Q111K/I336V/A540R | + | + | ++ | ++ |
| 1419/1420 | K33N/L46R/R56G/H234Y/A248V/G549D | + | ++ | + | ++ |
| 1421/1422 | K33N/R103L/Q111K/H234Y | + | ++ | + | + |
| 1423/1424 | K33N/Q37A/L46R/R56G/R103L/E523D/A540R/S548K/G549D | + | ++ | + | ++ |
| 1425/1426 | K33N/Q37A/L46R/R56G/Q111K/H234Y/E523D | + | ++ | + | ++ |
| 1427/1428 | K33N/Q37A/L46R/R103L/Q111K/S548K/G549D | + | ++ | + | ++ |
| 1429/1430 | Q37A/L46R/H234Y | + | ++ | ++ | ++ |
| 1431/1432 | L46R/H234Y/A540R/S548K | + | + | + | ++ |
| 1433/1434 | Q37A/Q111K/E523D | + | ++ | + | + |
| 1435/1436 | K33N/L46R | + | ++ | + | ++ |
| 1437/1438 | K33N/L46R/R103L/E523D/G549D | + | ++ | ++ | ++ |
| 1439/1440 | K33N/H234Y/I336V/E523D/A540R/S548K/G549D | + | ++ | + | ++ |
| 1441/1442 | Q37A/R56G/H234Y/I336V/E523D/A540R/S548K/G549D | + | +++ | + | ++ |
| 1443/1444 | K33N/Q111K/H234Y/S548K | + | ++ | + | ++ |
| 1445/1446 | K33N/R103L/Q111K/H234Y/I336V/E523D/S548K | + | ++ | + | ++ |
| 1447/1448 | K33N/R103L/Q111K/L336V | + | ++ | + | + |
| 1449/1450 | H234Y/E523D/A540R/S548K/G549D | + | ++ | ++ | ++ |
| 1451/1452 | K33N/H234Y/E523D/S548K | + | ++ | + | ++ |
| 1453/1454 | K33N/Q37A/H234Y/I336V/E523D/S548K | + | ++ | + | + |
| 1455/1456 | Q37A/L46R/I336V/E523D/A540R/S548K | + | ++ | ++ | ++ |
| 1457/1458 | Q37A/I336V | + | ++ | + | + |
| 1459/1460 | Q37A | + | ++ | + | + |
| 1461/1462 | Q37A/L46R/I336V/A540R/S548K | | + | + | ++ |
| 1463/1464 | K33N/Q37A/R56G/Q111K/H234Y/E523D/A540R/S548K | + | ++ | + | ++ |
| 1465/1466 | K33N/Q37A/L46R/I336V | + | ++ | + | ++ |
| 1467/1468 | E523D/S548K | + | + | + | + |
| 1469/1470 | K33N/Q37A/R56G/H234Y/E523D/A540R/S548K | + | ++ | + | ++ |
| 1471/1472 | L46R/R103L/A328Q/I336V/E523D | + | ++ | ++ | ++ |
| 1473/1474 | K33N/Q37A/Q111K/E523D/A540R | + | ++ | + | + |
| 1475/1476 | K33N/L46R/R56G/Q111K/S548K | + | ++ | + | ++ |
| 1477/1478 | K33N/H234Y/A540R/S548K/G549D | + | ++ | ++ | ++ |
| 1479/1480 | Q37A/S548K/G549D | + | ++ | + | ++ |
| 1481/1482 | K33N/H234Y/E523D/A540R/S548K | + | ++ | ++ | ++ |
| 1483/1484 | K33N/Q37A/L46R/R56G/Q111K/E523D/A540R | + | ++ | + | ++ |
| 1485/1486 | K33N/Q37A/L46R/S548K/G549D | + | ++ | ++ | ++ |
| 1487/1488 | K33N/Q37A/L46R/Q111K/H234Y/A328Q/E523D/A540R/S548K | + | ++ | ++ | ++ |
| 1489/1490 | I336V/E523D | + | ++ | + | + |
| 1491/1492 | K33N/Q37A/R103L/Q111K/H234Y/I336V/A540R/S548K | + | ++ | + | ++ |
| 1493/1494 | L46R/H234Y/I336V | ++ | ++ | ++ | ++ |
| 1495/1496 | K33N/R103L/Q111K/H234Y/A540R/G549D | + | ++ | + | ++ |
| 1497/1498 | K33N/Q37A/Q111K/H234Y/E523D/A540R/S548K | + | ++ | + | ++ |
| 1499/1500 | Q37A/R103L/I336V/S548K/G549D | + | ++ | + | ++ |
| 1501/1502 | Q37A/H234Y/A328Q/I336V/E523D | + | ++ | + | + |
| 1503/1504 | K33N/H234Y/A328Q/E523D/A540R/G549D | + | ++ | + | ++ |
| 1505/1506 | K33N/Q37A/L46R/H234Y/E523D | + | ++ | ++ | ++ |

TABLE 10-1-continued

Relative Activity of TAL Variants on Tyrosine under various conditions (Relative to SEQ ID NO: 790)[1]

| SEQ ID NO: (nt/aa) | Amino Acid Differences (Relative to SEQ ID NO: 790) | 2 mM Tyr FIOPC | Protease FIOPC | pH 4 FIOPC | Combined pH and Protease FIOPC |
|---|---|---|---|---|---|
| 1507/1508 | K33N/I336V/E523D/A540R/S548K/G549D | + | ++ | ++ | ++ |
| 1509/1510 | L46R/R103L/I336V | + | ++ | ++ | ++ |
| 1511/1512 | K33N/Q37A/L46R/R103L/E523D | + | ++ | ++ | ++ |
| 1513/1514 | K33N/Q37A/R103L/I336V/E523D/A540R/S548K | + | ++ | + | ++ |
| 1515/1516 | Q37A/R56G/I336V/E523D/A540R/S548K | + | ++ | + | ++ |

[1]All activities were determined relative to the reference polypeptide of SEQ ID NO: 790. Levels of increased activity are defined as follows: ""+"" = 0.9 to 1.2; "++" > 1.2; and "+++" > 2

TABLE 10-2

Relative Activity of TAL Variants on Tyrosine Under Various Conditions (Relative to SEQ ID NO: 790)[1]

| SEQ ID NO: (nt/aa) | Amino Acid Differences (Relative to SEQ ID NO: 790) | 2 mM tyr FIOPC | Protease FIOPC | pH 4 FIOPC |
|---|---|---|---|---|
| 1517/1518 | S424A | + | | |
| 1519/1520 | M102P | | +++ | + |
| 1521/1522 | G417A | ++ | ++ | + |
| 1523/1524 | L418V | ++ | + | + |
| 1525/1526 | I420L | + | + | + |
| 1527/1528 | S402A | + | ++ | + |
| 1529/1530 | T391N | + | ++ | + |
| 1531/1532 | M392A | + | + | + |
| 1533/1534 | L313M | ++ | + | + |
| 1535/1536 | L210T | ++ | ++ | + |
| 1537/1538 | D530V | ++ | ++ | + |
| 1539/1540 | L313I | ++ | ++ | ++ |
| 1541/1542 | I74A | ++ | ++ | + |
| 1543/1544 | L415F | ++ | | + |
| 1545/1546 | R506C | + | + | + |

[1]All activities were determined relative to the reference polypeptide of SEQ ID NO: 790. Levels of increased activity are defined as follows: ""+"" = 0.9 to 1.2; "++" > 1.2; and "+++" > 2.

Example 11

TAL Variants of SEQ ID NO: 1454

In this Example, experiments for evolution and screening of TAL variants derived from SEQ ID NO: 1454 for improved tyrosine activity, protease resistance, and low pH tolerance are described. Directed evolution of the TAL encoded by SEQ ID NO: 1454 was carried out by constructing libraries of variant genes. These libraries were then plated, grown, and screened using the methods described below.

HTP Activity Analysis of Clarified Lysates

HTP growth and lysis of E. coli cells expressing TAL variants were performed as described in Example 4. TAL variant activity on tyrosine was assayed as described in Example 4 with the following conditions: 20 μL of HTP lysate diluted 10-fold in water was assayed with 2.2 mM tyrosine for 5 min. The results of the assays are shown in Table 11-1, and SEQ ID NO: 1578 was selected for further directed evolution.

HTP Activity Analysis of Clarified Lysates Pretreated with Protease and/or Acidic Buffer TAL variants were challenged with chymotrypsin and trypsin as described in Example 10. Residual activity was determined as described in Example 10, and the results of this assay are shown in Table 11-1.

TAL variants were challenged with acidic buffer, whereby 50 μL of heat-treated clarified lysate was incubated with 50 μL McIlvaine buffer pH 3.8 for 1.5 h at 37° C. in a THERMOTRON® (INFORS) titre-plate shaker (400 rpm). After incubation, the lysate solutions were briefly centrifuged, and residual activity was determined by adding 40 μL of the acidic buffer-treated lysate to 160 μL of 200 mM sodium phosphate, 2.5 mM tyrosine, pH 7.0, in a 96-well UV-STAR® plate (Greiner Bio-One). The reactions were mixed briefly, and activity was determined as described in Example 10. The results of this assay are shown in Table 11-1.

In some instances, acidic buffer-treated lysate was further challenged with protease in a combined pH and protease assay. After 30 μL of heat-treated clarified lysate was incubated with 30 μL McIlvaine buffer pH 3.8 for 1.5 h at 37° C., 60 μL 4 g/L protease mix dissolved in 200 mM sodium phosphate dibasic was added, and the resulting solution was incubated for 2 h at 37° C. in a THERMOTRON® (INFORS) titre-plate shaker (400 rpm). Residual activity was determined as described in Example 10, and the results of this assay are shown in Table 11-1.

TABLE 11-1

Relative Activity of TAL Variants on Tyrosine Under Various Conditions (Relative to SEQ ID NO: 1454)[1]

| SEQ ID NO: (nt/aa) | Amino Acid Differences (Relative to SEQ ID NO: 1454) | 2 mM Tyr FIOPC | Protease FIOPC | pH 3.8 FIOPC | Combined pH and Protease FIOPC |
|---|---|---|---|---|---|
| 1547/1548 | I24T/K44R/G549D | | ++ | ++ | + |
| 1549/1550 | I24T/L46R/Q111K/R506C | + | ++ | ++ | + |
| 1551/1552 | I24T/K44R/L46R/L202R/T391N | | ++ | ++ | + |

TABLE 11-1-continued

Relative Activity of TAL Variants on Tyrosine Under Various Conditions (Relative to SEQ ID NO: 1454)[1]

| SEQ ID NO: (nt/aa) | Amino Acid Differences (Relative to SEQ ID NO: 1454) | 2 mM Tyr FIOPC | Protease FIOPC | pH 3.8 FIOPC | Combined pH and Protease FIOPC |
|---|---|---|---|---|---|
| 1553/1554 | Q111K/L202R/L313M/G417A/A540R/G549D | + | ++ | +++ | + |
| 1555/1556 | K44R/R103L/Q111K/L313M/T391N/A540R | | ++ | ++ | + |
| 1557/1558 | L313M/T391N/A540R/G549D | | ++ | | + |
| 1559/1560 | I24T/K44R/L202R/L313M/T391N/A540R | | ++ | ++ | + |
| 1561/1562 | I24T/L46R/R103L/T391N/R506C | | ++ | ++ | + |
| 1563/1564 | K44R/L46R/R103L/Q111K/T391N | | ++ | ++ | + |
| 1565/1566 | Q111K/L202R/T391N | | ++ | ++ | + |
| 1567/1568 | I24T/K44R/Q111K/L202R/R464Q/R506C | + | + | ++ | + |
| 1569/1570 | L202R/L313M/T391N/G549D | | ++ | ++ | + |
| 1571/1572 | L46R/Q111K/R506C | + | ++ | ++ | + |
| 1573/1574 | L202R/R506C/A540R/G549D | | + | +++ | + |
| 1575/1576 | R103L/L313M/G549D | + | + | + | ++ |
| 1577/1578 | I24T/L46R/M102P/L313M/R506C | + | ++ | ++ | ++ |
| 1579/1580 | I24T/L202R | + | ++ | ++ | + |
| 1581/1582 | Q111K/L202R/L313M/T391N/R506C | + | ++ | ++ | + |
| 1583/1584 | I24T/L46R/R103L/Q111K/R464Q/R506C/G549D | + | ++ | +++ | ++ |
| 1585/1586 | G417A | + | ++ | + | + |
| 1587/1588 | L202R/R506C7/A540R | + | + | +++ | + |
| 1589/1590 | Q111K | + | ++ | + | ++ |
| 1591/1592 | I24T | + | ++ | + | + |
| 1593/1594 | I24T/L46R/Q111K/L313M/T391N | | + | ++ | + |
| 1595/1596 | Q111K/L202R/L313M/T391N/R464Q | + | ++ | ++ | + |
| 1597/1598 | L46R/R103L/R506C | + | + | +++ | + |
| 1599/1600 | L202R/G417A/R464Q/A540R/G549D | + | ++ | +++ | ++ |
| 1601/1602 | K44R/L46R/R103L/L202R/L313M/T391N | + | ++ | ++ | ++ |
| 1603/1604 | I24T/R103L/L202R | + | ++ | +++ | ++ |
| 1605/1606 | I24T/L46R/L202R/T391N/R506C | | ++ | + | + |
| 1607/1608 | I24T/L46R/G549D | + | ++ | +++ | ++ |
| 1609/1610 | K44R/L46R/R103L/L202R/G417A/R464Q | + | + | ++ | + |
| 1611/1612 | L46R/L313M/T391N/A540R | + | ++ | ++ | + |
| 1613/1614 | L46R/L202R/R506C/G549D | | + | +++ | + |
| 1615/1616 | Q111K/L202R/T391N/A540R | | ++ | ++ | + |
| 1617/1618 | K44R/Q111K/R464Q/R506C | + | + | ++ | + |
| 1619/1620 | Q111K/L202R | ++ | ++ | +++ | ++ |
| 1621/1622 | I24T/K44R | + | + | ++ | + |
| 1623/1624 | L202R/R464Q/R506C | + | ++ | ++ | + |
| 1625/1626 | L46R/Q111K/G417A | + | ++ | ++ | + |
| 1627/1628 | L46R/L202R | + | ++ | +++ | ++ |
| 1629/1630 | I24T/L46R/Q111K/L313M/G549D | + | + | +++ | ++ |
| 1631/1632 | Q111K/R464Q/A540R/G549D | + | ++ | + | ++ |
| 1633/1634 | K44R/L46R/M102P/L202R/L313M/G417A | + | ++ | ++ | ++ |

[1]All activities were determined relative to the reference polypeptide SEQ ID NO: 1454. Levels of increased activity are defined as follows: ""+"" = 0.9 to 1.2; "++" > 1.2; and "+++" > 2

Example 12

TAL Variants of SEQ ID NO: 1578

In this Example, experiments for evolution and screening of TAL variants derived from SEQ ID NO: 1578, for improved tyrosine activity, protease resistance, and low pH tolerance are described. Directed evolution of the TAL encoded by SEQ ID NO: 1578 was carried out by constructing libraries of variant genes. These libraries were then plated, grown, and screened using the methods described below.

HTP Activity Analysis of Clarified Lysates

HTP growth and lysis of E. coli cells expressing TAL variants were performed as described in Example 4. TAL variant activity on tyrosine was assayed as described in Example 4, with the following conditions: 20 µL of HTP lysate diluted 8-fold in water was assayed with 2.2 mM tyrosine for 5 min. The results of the assays are shown in Table 12-1. Based on the results, SEQ ID NO: 1660 was selected for further directed evolution.

HTP Activity Analysis of Clarified Lysates Pretreated with Protease and/or Acidic Buffer TAL variants were challenged with chymotrypsin and trypsin as described in Example 10. The residual activity was determined as described in Example 10. The results of this assay are shown in Table 12-1.

TAL variants were challenged with acidic buffer, whereby 70 µL of heat-treated clarified lysate was incubated with 70 µL McIlvaine buffer pH 4 for 1.5 h at 37° C. in a THERMOTRON® (INFORS) titre-plate shaker (400 rpm). The residual activity was determined as described in Example 10. The results of this assay are shown in Table 12-1.

In some instances, acidic buffer-treated lysate was further challenged with protease in a combined pH and protease assay. Specifically, lysate challenged with acidic buffer as described above was centrifuged, and 50 µL of the supernatant was incubated with 50 µL 4 g/L protease mix dissolved in 100 mM sodium phosphate pH 8. The resulting solution was incubated for 2 h at 37° C. in a THERMOTRON® (INFORS) titre-plate shaker (400 rpm), and the residual activity was determined as described in Example 10. The results of this assay are shown in Table 12-1.

TABLE 12-1

Relative Activity of TAL Variants on Tyrosine under
Various Conditions (Relative to SEQ ID NO: 1578)[1]

| SEQ ID NO: (nt/aa) | Amino Acid Differences (Relative to SEQ ID NO: 1578) | 2 mM Tyr FIOPC | Protease FIOPC | pH 4 FIOPC | Combined pH and Protease FIOPC |
|---|---|---|---|---|---|
| 1635/1636 | D20G/K44R/L202R/C506R | ++ | ++ | ++ | ++ |
| 1637/1638 | R103L/L202R/A540R | ++ | ++ | ++ | ++ |
| 1639/1640 | Q111K | ++ | ++ | ++ | ++ |
| 1641/1642 | R103L/R464Q/G549D | + | ++ | + | ++ |
| 1643/1644 | Q111K/C506R | ++ | ++ | ++ | ++ |
| 1645/1646 | K44R/L202R/R464Q/C506R | ++ | ++ | ++ | ++ |
| 1647/1648 | R464Q/C506R | ++ | ++ | ++ | ++ |
| 1649/1650 | Q111K/L202R/M313L/Q471Y/C506R | ++ | ++ | ++ | ++ |
| 1651/1652 | C506R | ++ | ++ | ++ | ++ |
| 1653/1654 | R103L/Q471Y | ++ | ++ | + | ++ |
| 1655/1656 | M313L/R464Q/Q471Y/C506R | + | ++ | + | ++ |
| 1657/1658 | L202R/R464Q/C506R | ++ | ++ | ++ | ++ |
| 1659/1660 | L202R/R464Q/C506R/G549D | ++ | ++ | ++ | ++ |
| 1661/1662 | R103L/Q111K/Q471Y | ++ | ++ | + | ++ |
| 1663/1664 | R56G/Q111K/C506R | ++ | ++ | ++ | ++ |
| 1665/1666 | C506R/G549D | + | ++ | ++ | ++ |
| 1667/1668 | R103L/Q111K/L202R/R464Q/Q471Y | ++ | ++ | ++ | ++ |
| 1669/1670 | D20G/L202R/M313L/Q471Y/C506R | ++ | ++ | ++ | ++ |
| 1671/1672 | L202R | ++ | ++ | ++ | ++ |
| 1673/1674 | Q111K/L202R/Q471Y | ++ | ++ | ++ | ++ |
| 1675/1676 | R56G/C506R | ++ | ++ | ++ | ++ |
| 1677/1678 | K44R/Q111K/L202R/R464Q/Q471Y/C506R/G549D | ++ | ++ | ++ | ++ |
| 1679/1680 | D20G/R103L/Q111K/Q471Y/C506R | ++ | ++ | ++ | ++ |
| 1681/1682 | L202R/M313L/R464Q/Q471Y/C506R | ++ | ++ | ++ | ++ |
| 1683/1684 | Q111K/L202R/M313L/L316Q | ++ | ++ | + | + |
| 1685/1686 | T24S | ++ | ++ | ++ | ++ |
| 1687/1688 | R504A | ++ | ++ | ++ | ++ |
| 1689/1690 | Y41L | ++ | ++ | ++ | ++ |
| 1691/1692 | R464S | ++ | ++ | ++ | ++ |
| 1693/1694 | A540R | ++ | ++ | ++ | ++ |
| 1695/1696 | Y41N | ++ | ++ | ++ | ++ |
| 1697/1698 | R464N | ++ | ++ | ++ | ++ |
| 1699/1700 | R504L | ++ | ++ | ++ | ++ |
| 1701/1702 | Y41H | ++ | ++ | + | ++ |
| 1703/1704 | Q66K | ++ | ++ | ++ | ++ |
| 1705/1706 | E51H | ++ | ++ | ++ | ++ |
| 1707/1708 | Q305E | ++ | ++ | ++ | ++ |
| 1709/1710 | R46S | ++ | ++ | ++ | ++ |
| 1711/1712 | A59S | ++ | ++ | ++ | ++ |
| 1713/1714 | K44E | ++ | ++ | ++ | ++ |
| 1715/1716 | Q66T | ++ | ++ | ++ | ++ |
| 1717/1718 | T24K | ++ | ++ | ++ | ++ |
| 1719/1720 | Q305D | ++ | ++ | ++ | ++ |
| 1721/1722 | Y41S | ++ | ++ | + | ++ |
| 1723/1724 | K44R | ++ | ++ | ++ | ++ |
| 1725/1726 | Y41Q | ++ | ++ | + | ++ |
| 1727/1728 | T48A | ++ | ++ | + | + |
| 1729/1730 | D523H | ++ | ++ | ++ | ++ |
| 1731/1732 | Q66N | ++ | ++ | ++ | ++ |
| 1733/1734 | A36S | ++ | ++ | ++ | + |
| 1735/1736 | A59N | ++ | ++ | ++ | + |
| 1737/1738 | K50M | ++ | ++ | ++ | ++ |
| 1739/1740 | K44S | ++ | ++ | ++ | + |
| 1741/1742 | A519P | ++ | ++ | ++ | ++ |
| 1743/1744 | A519E | ++ | ++ | ++ | + |
| 1745/1746 | D27S | ++ | ++ | ++ | + |
| 1747/1748 | A36T | ++ | ++ | ++ | + |
| 1749/1750 | A519K | ++ | ++ | ++ | ++ |
| 1751/1752 | K44P | ++ | ++ | ++ | ++ |
| 1753/1754 | T24E | ++ | ++ | ++ | ++ |
| 1755/1756 | K518S | ++ | ++ | ++ | ++ |
| 1757/1758 | C500L | ++ | ++ | ++ | ++ |
| 1759/1760 | T48G | ++ | ++ | + | + |
| 1761/1762 | A540H | ++ | ++ | ++ | ++ |
| 1763/1764 | L208M | ++ | ++ | ++ | ++ |
| 1765/1766 | Q66H/W528R | ++ | ++ | ++ | ++ |
| 1767/1768 | T547G | ++ | ++ | ++ | ++ |
| 1769/1770 | A519T | ++ | ++ | ++ | + |
| 1771/1772 | Y41A | ++ | ++ | + | ++ |
| 1773/1774 | T24Q | ++ | ++ | + | ++ |
| 1775/1776 | R46A | ++ | ++ | + | + |
| 1777/1778 | Q55S | ++ | ++ | ++ | ++ |

TABLE 12-1-continued

Relative Activity of TAL Variants on Tyrosine under
Various Conditions (Relative to SEQ ID NO: 1578)[1]

| SEQ ID NO: (nt/aa) | Amino Acid Differences (Relative to SEQ ID NO: 1578) | 2 mM Tyr FIOPC | Protease FIOPC | pH 4 FIOPC | Combined pH and Protease FIOPC |
|---|---|---|---|---|---|
| 1779/1780 | E51A | ++ | ++ | ++ | ++ |
| 1781/1782 | P197V | ++ | ++ | + | ++ |
| 1783/1784 | N33E | ++ | ++ | ++ | ++ |
| 1785/1786 | T547M/V553I | ++ | ++ | ++ | ++ |
| 1787/1788 | P272A | ++ | ++ | ++ | ++ |
| 1789/1790 | A331G | ++ | ++ | ++ | ++ |
| 1791/1792 | A543T | ++ | ++ | ++ | ++ |
| 1793/1794 | A543V | ++ | ++ | ++ | ++ |
| 1795/1796 | I556L | ++ | ++ | ++ | ++ |
| 1797/1798 | A555S | ++ | ++ | ++ | ++ |
| 1799/1800 | Q470I | ++ | ++ | ++ | ++ |
| 1801/1802 | V559Y | ++ | ++ | ++ | ++ |
| 1803/1804 | Q289L | ++ | ++ | ++ | ++ |
| 1805/1806 | K332N | ++ | ++ | ++ | ++ |
| 1807/1808 | R292L/V553S | + | ++ | + | + |
| 1809/1810 | Q470T | ++ | ++ | ++ | ++ |
| 1811/1812 | Y432L | ++ | ++ | ++ | ++ |
| 1813/1814 | S435T | ++ | ++ | ++ | ++ |
| 1815/1816 | C506E | ++ | ++ | ++ | ++ |
| 1817/1818 | V559C | ++ | ++ | ++ | ++ |
| 1819/1820 | I556V | ++ | ++ | ++ | ++ |
| 1821/1822 | V559I | ++ | ++ | ++ | ++ |
| 1823/1824 | V559H | ++ | ++ | ++ | ++ |
| 1825/1826 | V559M | ++ | ++ | ++ | ++ |
| 1827/1828 | Y432T | ++ | ++ | ++ | ++ |
| 1829/1830 | V559L | ++ | ++ | ++ | ++ |
| 1831/1832 | S312C/V559Y | ++ | ++ | ++ | ++ |
| 1833/1834 | S435A | ++ | ++ | ++ | ++ |

[1] All activities were determined relative to the reference polypeptide of SEQ ID NO: 1578. Levels of increased activity are defined as follows: ""+"" = 0.9 to 1.2; and "++" > 1.2.

Example 13

TAL Variants of SEQ ID NO: 1660

In this Example, experiments for evolution and screening of TAL variants derived from SEQ ID NO: 1660, for improved tyrosine activity, protease resistance, and low pH tolerance are described. Directed evolution of the TAL encoded by SEQ ID NO: 1660 was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4, with the following conditions: 20 µL of HTP lysate diluted 8-fold in water was assayed with 2.2 mM tyrosine for 5 min. The results of the assays are shown in Table 13-1. Based on the results, SEQ ID NO: 1844 was selected for further directed evolution.

HTP Activity Analysis of Clarified Lysates Pretreated with Protease and/or Acidic Buffer TAL variants were challenged with chymotrypsin and trypsin, whereby 50 µL of HTP lysate diluted 2 or 2.5-fold was incubated with 50 µL 4 g/L protease mix for 2 h at 37° C., in a THERMOTRON® (INFORS) titre-plate shaker (400 rpm). Protease mix consisted of 4 mg/mL chymotrypsin (Sigma Aldrich) and 4 mg/mL trypsin (Sigma Aldrich) in 100 mM sodium phosphate pH 8.0. Residual activity was determined as described in Example 10. The results of this assay are shown in Table 13-1.

TAL variants were challenged with acidic buffer as described in Example 12. Residual activity was determined as described in Example 10. The results of this assay are shown in Table 13-1.

In some instances, acidic buffer-treated lysate was further challenged with protease in a combined pH and protease assay, as described in Example 12. Residual activity was determined as described in Example 10. The results of this assay are shown in Table 13-1.

TABLE 13-1

Relative Activity of TAL Variants on Tyrosine Under
Various Conditions (Relative to SEQ ID NO: 1660)[1]

| SEQ ID NO: (nt/aa) | Amino Acid Differences (Relative to SEQ ID NO: 1660) | 2 mM Tyr FIOPC | Protease FIOPC | pH 4 FIOPC | Combined pH and Protease FIOPC |
|---|---|---|---|---|---|
| 1835/1836 | A36S/P197V/Q305D/K332N/C500L | ++ | ++ | ++ | ++ |
| 1837/1838 | Q305D/K332N/G457S/C500L | ++ | ++ | ++ | ++ |
| 1839/1840 | A36S/Q55S/Q305D/K332N/P410M | +++ | ++ | ++ | ++ |

TABLE 13-1-continued

Relative Activity of TAL Variants on Tyrosine Under
Various Conditions (Relative to SEQ ID NO: 1660)[1]

| SEQ ID NO: (nt/aa) | Amino Acid Differences (Relative to SEQ ID NO: 1660) | 2 mM Tyr FIOPC | Protease FIOPC | pH 4 FIOPC | Combined pH and Protease FIOPC |
|---|---|---|---|---|---|
| 1841/1842 | A36S/P197V/Q305D/K332N/P410M | ++ | ++ | ++ | ++ |
| 1843/1844 | A36S/Q305D/K332N/P410M | +++ | ++ | ++ | ++ |
| 1845/1846 | A36S/Q305D/P410M | ++ | ++ | ++ | ++ |
| 1847/1848 | A36S/P197V/Q305D/K332N/P410M/V559I | ++ | ++ | ++ | ++ |
| 1849/1850 | Q305D/K332N/P410M | +++ | ++ | ++ | ++ |
| 1851/1852 | Q305D | ++ | ++ | ++ | ++ |
| 1853/1854 | A36S/Q66N/P197V/Q305D/K332N/G457S | ++ | ++ | ++ | ++ |
| 1855/1856 | Q55S/Q305D/K332N/G457S/A543V/T547G | ++ | ++ | ++ | ++ |
| 1857/1858 | Q66N/Q305D/K332N | ++ | ++ | ++ | ++ |
| 1859/1860 | A36S/P197V/Q305D/P410M | ++ | ++ | ++ | ++ |
| 1861/1862 | Q305D/C500L/A543V/T547G | ++ | ++ | ++ | ++ |
| 1863/1864 | Q305D/K332N/P410M/C500L | +++ | ++ | +++ | ++ |
| 1865/1866 | P197V/Q305D | ++ | ++ | ++ | ++ |
| 1867/1868 | A36S/Q66N/P197V/Q305D/P410M | +++ | ++ | ++ | ++ |
| 1869/1870 | A36S/P197V/Q305D | ++ | ++ | ++ | ++ |
| 1871/1872 | A36S/Q66N/Q305D/K332N/P410M | +++ | ++ | +++ | ++ |
| 1873/1874 | P197V/Q305D/P410M | +++ | ++ | +++ | ++ |
| 1875/1876 | Q305D/K332N | ++ | ++ | ++ | ++ |
| 1877/1878 | A36S/P197V/Q305D/C500L | ++ | +++ | ++ | ++ |
| 1879/1880 | A36S/Q305D/K332N | ++ | ++ | ++ | ++ |
| 1881/1882 | A36S/Q66N/Q305D/C500L | ++ | ++ | ++ | ++ |
| 1883/1884 | Q55S/Q305D/C500L/V559I | ++ | ++ | ++ | ++ |
| 1885/1886 | Q305D/K332N/C500L | ++ | ++ | ++ | ++ |
| 1887/1888 | P197V/Q305D/K332N/P410M | +++ | ++ | ++ | ++ |
| 1889/1890 | Q305D/P410M | +++ | ++ | +++ | ++ |
| 1891/1892 | A36S/P197V/Q305D/K332N/P410M/C500L | +++ | ++ | +++ | ++ |
| 1893/1894 | Q55S/Q305D | ++ | ++ | ++ | ++ |
| 1895/1896 | A36S/Q305D | ++ | ++ | ++ | ++ |
| 1897/1898 | P197V/Q305D/K332N/C500L/A543V/T547G | ++ | ++ | ++ | ++ |
| 1899/1900 | Q66N/Q305D | ++ | ++ | ++ | ++ |
| 1901/1902 | A36S/Q66N/Q305D | ++ | ++ | ++ | ++ |
| 1903/1904 | P197V/Q305D/C500L | ++ | ++ | ++ | ++ |
| 1905/1906 | S134C/R202L/Q305D | ++ | ++ | ++ | ++ |
| 1907/1908 | Q305D/K332N/G457S/A555S | ++ | ++ | ++ | + |
| 1909/1910 | Q305D/K332N/G457S | ++ | ++ | ++ | ++ |
| 1911/1912 | P272A/S435T/Y526L | ++ | ++ | ++ | ++ |
| 1913/1914 | L208M/P272A/Y432L | ++ | ++ | ++ | + |
| 1915/1916 | R46S/Q111K/L208M/P272A/S435T/Y526L | ++ | ++ | ++ | ++ |
| 1917/1918 | Q111K/P272A/Q471Y/Y526L | ++ | ++ | ++ | ++ |
| 1919/1920 | L208M | ++ | ++ | ++ | ++ |
| 1921/1922 | Q111K/P272A/Y432T/S435T | ++ | ++ | ++ | ++ |
| 1923/1924 | Y432L/Y526L | ++ | ++ | ++ | ++ |
| 1925/1926 | D20G/P197V/Y432T/A519K | ++ | ++ | ++ | ++ |
| 1927/1928 | K44E/R46S/Q111K/L208M | ++ | ++ | ++ | ++ |
| 1929/1930 | Q111K/Y526L | ++ | + | ++ | + |
| 1931/1932 | Q111K | + | + | + | + |
| 1933/1934 | S435T | + | + | + | + |
| 1935/1936 | Q471Y | + | + | + | + |
| 1937/1938 | R46S/Y432L/Q471Y | + | + | + | + |
| 1939/1940 | K44E/R46S/Q111K/Y432T/A519K | + | + | + | + |
| 1941/1942 | Q111K/P272A/A519K | + | + | + | + |
| 1943/1944 | L208M/P410M/S435T | ++ | + | ++ | ++ |
| 1945/1946 | Y41L/Y432T/Y526L | ++ | ++ | ++ | + |
| 1947/1948 | T24E/R46S/P410M/S435T/K518S | ++ | ++ | ++ | ++ |
| 1949/1950 | D20G | ++ | ++ | ++ | ++ |
| 1951/1952 | L208M/S435T/A519K | ++ | ++ | ++ | ++ |
| 1953/1954 | S435T/A519K/Y526L | ++ | ++ | ++ | ++ |
| 1955/1956 | R46S/L208M/P272A/Y432L/S435T/Y526L | ++ | ++ | ++ | ++ |
| 1957/1958 | P272A | ++ | ++ | + | ++ |
| 1959/1960 | K44E/Q111K/Y432L/A519K/Y526L | ++ | ++ | ++ | ++ |
| 1961/1962 | D20G/K44E/L208M/P272A/A519K | + | ++ | + | + |
| 1963/1964 | T24E | + | ++ | + | + |
| 1965/1966 | D20G/Q111K/L208M/P272A/P410M/Y432T | ++ | ++ | ++ | ++ |
| 1967/1968 | Q111K/Y432T/Y526L | ++ | ++ | ++ | +++ |
| 1969/1970 | Q471Y/Y526L | ++ | ++ | ++ | ++ |
| 1971/1972 | A519K | ++ | ++ | ++ | ++ |
| 1973/1974 | K44E/L208M/Y432T/S435T | ++ | ++ | ++ | ++ |
| 1975/1976 | S435T/K518S | ++ | ++ | ++ | ++ |
| 1977/1978 | Q111K/Y432L/S435T | ++ | ++ | + | ++ |
| 1979/1980 | Y41L/K44E/R46S/Q111K/P272A | ++ | ++ | ++ | + |
| 1981/1982 | L211Q/P410I | + | + | + | + |

TABLE 13-1-continued

Relative Activity of TAL Variants on Tyrosine Under
Various Conditions (Relative to SEQ ID NO: 1660)[1]

| SEQ ID NO: (nt/aa) | Amino Acid Differences (Relative to SEQ ID NO: 1660) | 2 mM Tyr FIOPC | Protease FIOPC | pH 4 FIOPC | Combined pH and Protease FIOPC |
|---|---|---|---|---|---|
| 1983/1984 | S298G/P410I | ++ | ++ | ++ | + |
| 1985/1986 | P410L | + | + | + | + |

[1]All activities were determined relative to the reference polypeptide of SEQ ID NO: 1660. Levels of increased activity are defined as follows: ""+"" = 0.9 to 1.2; "++" > 1.2; and "+++" > 2.

Example 14

TAL Variants of SEQ ID NO: 1844

In this Example, experiments for evolution and screening of TAL variants derived from SEQ ID NO: 1844, for improved tyrosine activity, protease resistance, and low pH tolerance are described. Directed evolution of the TAL encoded by SEQ ID NO: 1844 was carried out by constructing libraries of variant genes. These libraries were then plated, grown, and screened using the methods described below.

HTP Activity Analysis of Clarified Lysates

HTP growth and lysis of E. coli cells expressing TAL variants were performed as described in Example 4. TAL variant activity on tyrosine was assayed as described in Example 4, with the following conditions: 20 µL of HTP lysate diluted 10-fold in water was assayed with 2.2 mM tyrosine for 5 min. The results of the assays are shown in Table 14-1. Based on the results, SEQ ID NO: 2030 was selected for further directed evolution.

HTP Activity Analysis of Clarified Lysates Pretreated with Protease and/or Acidic Buffer TAL variants were challenged with chymotrypsin and trypsin, whereby 50 µL of HTP lysate diluted 2.5-fold was incubated with 50 µL 4 g/L protease mix for 2 h at 37° C. in a THERMOTRON® (INFORS) titre-plate shaker (400 rpm). Protease mix consisted of 4 mg/mL chymotrypsin (Sigma Aldrich) and 4 mg/mL trypsin (Sigma Aldrich) in 100 mM sodium phosphate pH 8.0. Residual activity was determined as described in Example 10. The results of this assay are shown in Table 14-1.

TAL variants were challenged with acidic buffer as described in Example 12. Residual activity was determined as described in Example 10. The results of this assay are shown in Table 14-1.

In some instances, acidic buffer-treated lysate was further challenged with protease in a combined pH and protease assay. Specifically, lysate challenged with acidic buffer as described above was centrifuged, and 40 µL of the supernatant was incubated with 60 µL 4 g/L protease mix dissolved in 100 mM sodium phosphate pH 8. The resulting solution was incubated for 2 h at 37° C., in a THERMOTRON® (INFORS) titre-plate shaker (400 rpm), and residual activity was determined as described in Example 10. The results of this assay are shown in Table 14-1.

TABLE 14-1

Relative Activity of TAL Variants on Tyrosine Under
Various Conditions (Relative to SEQ ID NO: 1844)[1]

| SEQ ID NO: (nt/aa) | Amino Acid Differences (Relative to SEQ ID NO: 1844) | 2 mM Tyr FIOPC | Protease FIOPC | pH 4 FIOPC | Combined pH and Protease FIOPC |
|---|---|---|---|---|---|
| 1987/1988 | Q111K/Q289L | +++ | +++ | ++ | +++ |
| 1989/1990 | Q289L/R504A | +++ | +++ | ++ | +++ |
| 1991/1992 | A59S/Q289L/S435T | +++ | +++ | ++ | +++ |
| 1993/1994 | Q111K/Q289L/C500L | +++ | +++ | ++ | +++ |
| 1995/1996 | Q111K/Y432L | +++ | +++ | ++ | +++ |
| 1997/1998 | Q289L/S435T/R504A/I556L | +++ | +++ | ++ | +++ |
| 1999/2000 | A59S/Q289L | +++ | +++ | ++ | +++ |
| 2001/2002 | Q111K | +++ | +++ | ++ | ++ |
| 2003/2004 | Q289L | +++ | +++ | ++ | +++ |
| 2005/2006 | Q111K/Y432L/C500L | ++ | ++ | ++ | ++ |
| 2007/2008 | Q289L/S435T/C500L/R504A | +++ | +++ | ++ | +++ |
| 2009/2010 | A59S/Y432L/S435T/R504A/I556L | ++ | ++ | ++ | ++ |
| 2011/2012 | A59S/Q66T/Q289L/C500L/R504A/I556L | ++ | ++ | ++ | ++ |
| 2013/2014 | S435T/R504A | ++ | ++ | ++ | ++ |
| 2015/2016 | Q289L/Y432L | ++ | ++ | ++ | ++ |
| 2017/2018 | Q111K/Q289L/S435T/C500L | ++ | ++ | ++ | ++ |
| 2019/2020 | A59S/Q66T/Q111K/Q289L/Y432L/C500L | ++ | ++ | ++ | ++ |
| 2021/2022 | A59S/Q111K/Y432L/C500L | +++ | ++ | ++ | ++ |
| 2023/2024 | T24K/A59S/Q111K/Q289L/R504A | ++ | ++ | ++ | ++ |
| 2025/2026 | Q66T/Q111K | +++ | ++ | ++ | ++ |
| 2027/2028 | T24K/Q111K/Q289L | ++ | ++ | ++ | ++ |
| 2029/2030 | Q289L/Y432L/S435T | ++ | +++ | ++ | ++ |
| 2031/2032 | T24K/Q289L | ++ | ++ | ++ | ++ |
| 2033/2034 | T24K/Q111K/Q289L/C500L/R504A | ++ | ++ | ++ | ++ |
| 2035/2036 | T24K/Q111K/S435T/C500L | +++ | ++ | ++ | ++ |
| 2037/2038 | R504A/I556L | ++ | ++ | ++ | ++ |
| 2039/2040 | Q111K/A331G/Y432L/R504A | ++ | ++ | ++ | +++ |

TABLE 14-1-continued

Relative Activity of TAL Variants on Tyrosine Under
Various Conditions (Relative to SEQ ID NO: 1844)[1]

| SEQ ID NO: (nt/aa) | Amino Acid Differences (Relative to SEQ ID NO: 1844) | 2 mM Tyr FIOPC | Protease FIOPC | pH 4 FIOPC | Combined pH and Protease FIOPC |
|---|---|---|---|---|---|
| 2041/2042 | Q111K/C500L/R504A | +++ | ++ | ++ | ++ |
| 2043/2044 | Q111K/A331G/S435T/C500L | ++ | ++ | ++ | ++ |
| 2045/2046 | A59S/Q66T/Q111K/Y432L/C500L | +++ | ++ | ++ | ++ |
| 2047/2048 | A59S/Q66T/Q111K/Y432L/R504A | +++ | +++ | ++ | ++ |
| 2049/2050 | T24K/Q111K/Y432L | ++ | ++ | ++ | ++ |
| 2051/2052 | A59S/Y432L | ++ | +++ | ++ | +++ |
| 2053/2054 | Q111K/Q289L/S435T | ++ | +++ | ++ | ++ |
| 2055/2056 | R504A | ++ | +++ | ++ | ++ |
| 2057/2058 | Q289L/S435T | ++ | +++ | ++ | ++ |
| 2059/2060 | T24K/Y432L/S435T/R504A | ++ | ++ | ++ | ++ |
| 2061/2062 | A59S/Q111K | ++ | +++ | ++ | ++ |
| 2063/2064 | Y432L | ++ | ++ | ++ | ++ |
| 2065/2066 | L211Q/K518S/A519T/T547G | +++ | ++ | ++ | ++ |
| 2067/2068 | Y41Q/L208M/T547G | +++ | ++ | ++ | ++ |
| 2069/2070 | L208M/L211Q/T547G | ++ | ++ | ++ | ++ |
| 2071/2072 | Y41Q/E51A/M410L/A543V | ++ | ++ | ++ | ++ |
| 2073/2074 | E51A/A519T | ++ | ++ | ++ | ++ |
| 2075/2076 | L208M | ++ | ++ | ++ | ++ |
| 2077/2078 | L211Q/T547G | ++ | ++ | ++ | ++ |
| 2079/2080 | L211Q | ++ | ++ | ++ | ++ |
| 2081/2082 | Y41Q/L208M/K518S/A519T/T547G | ++ | ++ | ++ | ++ |
| 2083/2084 | Y41Q/M410L/K518S/T547G | ++ | ++ | + | ++ |
| 2085/2086 | T547G | ++ | ++ | ++ | ++ |
| 2087/2088 | L208M/L211Q/M410L/A519T | ++ | ++ | ++ | ++ |
| 2089/2090 | Y41Q/K44P/L208M/T547G | ++ | ++ | ++ | ++ |
| 2091/2092 | K44R/L208M/K518S/T547G | ++ | ++ | ++ | ++ |
| 2093/2094 | Y41Q/L208M/M410L/A543V/T547G | ++ | ++ | ++ | ++ |
| 2095/2096 | Y41Q/M410L/K518S/A543V | ++ | ++ | + | ++ |
| 2097/2098 | A519T | ++ | ++ | ++ | ++ |
| 2099/2100 | M410L | ++ | ++ | + | ++ |
| 2101/2102 | Y41Q/A543V | +++ | ++ | ++ | ++ |

[1]All activities were determined relative to the reference polypeptide of SEQ ID NO: 1844. Levels of increased activity are defined as follows: ""+"" = 0.9 to 1.2; "++" > 1.2; and "+++" > 2.

Example 15

TAL Variants of SEQ ID NO: 2030

In this Example, experiments for evolution and screening of TAL variants derived from SEQ ID NO: 2030, for improved tyrosine activity, protease resistance, and low pH tolerance are described. Directed evolution of the TAL encoded by SEQ ID NO: 2030, was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4, with the following conditions: 20 µL of HTP lysate diluted 10-fold in water was assayed with 2.2 mM tyrosine for 5 min. The results of the assays are shown in Table 15-1. Based on the results, SEQ ID NO: 2114 was selected for further directed evolution.

HTP Activity Analysis of Clarified Lysates Pretreated with Protease and/or Acidic Buffer TAL variants were challenged with chymotrypsin and trypsin as described in Example 14. Residual activity was determined as described in Example 10. The results of this assay are shown in Table 15-1.

TAL variants were challenged with acidic buffer as described in Example 12, with the exception that lysate was incubated with McIlvaine buffer, pH 3.8. Residual activity was determined as described in Example 10. The results of this assay are shown in Table 15-1.

In some instances, acidic buffer-treated lysate was further challenged with protease in a combined pH and protease assay. Specifically, lysate challenged with acidic buffer as described above was centrifuged, and 50 µL of the supernatant was incubated with 50 µL 4 g/L pancreatin dissolved in 100 mM sodium phosphate pH 8. The resulting solution was incubated for 2 h at 37° C., in a THERMOTRON® (INFORS) titre-plate shaker (400 rpm), and residual activity was determined as described in Example 10. The results of this assay are shown in Table 15-1.

TABLE 15-1

Relative Activity of TAL Variants on Tyrosine Under
Various Conditions (Relative to SEQ ID NO: 2030)[1]

| SEQ ID NO: (nt/aa) | Amino Acid Differences (Relative to SEQ ID NO: 2030) | 2 mM Tyr FIOPC | Protease FIOPC | pH 3.8 FIOPC | Combined pH and Protease FIOPC |
|---|---|---|---|---|---|
| 2103/2104 | A45V/L244M/A324V/K513R | + | ++ | + | + |
| 2105/2106 | A45V/L436I/I512V/K513R | + | ++ | + | + |

TABLE 15-1-continued

Relative Activity of TAL Variants on Tyrosine Under
Various Conditions (Relative to SEQ ID NO: 2030)[1]

| SEQ ID NO: (nt/aa) | Amino Acid Differences (Relative to SEQ ID NO: 2030) | 2 mM Tyr FIOPC | Protease FIOPC | pH 3.8 FIOPC | Combined pH and Protease FIOPC |
|---|---|---|---|---|---|
| 2107/2108 | K13Q/A45V/I512V | + | ++ | + | + |
| 2109/2110 | K13S/V22T/A45V/I512V | + | ++ | + | + |
| 2111/2112 | K13S/A45V | + | ++ | + | + |
| 2113/2114 | A45V/I512V | + | ++ | + | + |
| 2115/2116 | Q8D | ++ | ++ | + | + |
| 2117/2118 | L428V | ++ | ++ | + | + |
| 2119/2120 | T11G | + | ++ | + | + |
| 2121/2122 | A4D | ++ | ++ | + | + |
| 2123/2124 | A45V | + | ++ | + | + |
| 2125/2126 | T17Q | + | ++ | + | + |
| 2127/2128 | L251V | + | ++ | + | + |
| 2129/2130 | T11D | ++ | ++ | + | ++ |
| 2131/2132 | K13R | + | ++ | + | + |
| 2133/2134 | T11A | + | ++ | + | + |
| 2135/2136 | T11S | + | ++ | + | + |
| 2137/2138 | Q8R | ++ | ++ | + | + |
| 2139/2140 | T11K | + | + | + | + |
| 2141/2142 | V341A | + | + | + | + |
| 2143/2144 | S19H | + | + | + | + |
| 2145/2146 | A324R | + | + | + | + |
| 2147/2148 | Q8G | + | + | + | + |
| 2149/2150 | I144L | | + | | + |
| 2151/2152 | I327M | + | + | + | + |

[1]All activities were determined relative to the reference polypeptide of SEQ ID NO: 2030. Levels of increased activity are defined as follows: ""+"" = 0.9 to 1.2; and "++" > 1.2.

Example 16

TAL Variants of SEQ ID NO: 2114

In this Example, experiments for evolution and screening of TAL variants derived from SEQ ID NO: 2114, for improved tyrosine activity, protease resistance, and low pH tolerance are described. Directed evolution of the TAL encoded by SEQ ID NO: 2114, was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4, with the following conditions: 20 μL of HTP lysate diluted 10-fold in water was assayed with 2.2 mM tyrosine for 5 min. The results of the assays are shown in Table 16-1. Based on the results, SEQ ID NO: 2156 was selected for further directed evolution.

HTP Activity Analysis of Clarified Lysates Pretreated with Protease and/or Acidic Buffer TAL variants were challenged with chymotrypsin and trypsin as described in Example 15. Residual activity was determined as described in Example 10. The results of this assay are shown in Table 16-1.

TAL variants were challenged with acidic buffer as described in Example 15. Residual activity was determined as described in Example 10. The results of this assay are shown in Table 16-1.

In some instances, acidic buffer-treated lysate was further challenged with protease in a combined pH and protease assay as described in Example 15, and residual activity was determined as described in Example 10. The results of this assay are shown in Table 16-1.

TABLE 16-1

Relative Activity of TAL Variants on Tyrosine Under
Various Conditions (Relative to SEQ ID NO: 2114)[1]

| SEQ ID NO: (nt/aa) | Amino Acid Differences (Relative to SEQ ID NO: 2114) | 2 mM Tyr FIOPC | Protease FIOPC | pH 3.8 FIOPC | Combined pH and Protease FIOPC |
|---|---|---|---|---|---|
| 2153/2154 | Q8D/T11D/Q111K/R504A | ++ | ++ | ++ | ++ |
| 2155/2156 | Q8D/T11D/T17Q/V22T/A324V/R504A/A519T | ++ | ++ | ++ | ++ |
| 2157/2158 | A4D | ++ | ++ | ++ | ++ |
| 2159/2160 | A4D/L428V | ++ | ++ | ++ | ++ |
| 2161/2162 | A4D/Q8R/T11D/K13R/V22T/Q111K/R504A | ++ | ++ | ++ | ++ |
| 2163/2164 | A4D/A324V | ++ | ++ | ++ | ++ |
| 2165/2166 | T11D/T17Q/V22T/A324V | ++ | ++ | ++ | ++ |
| 2167/2168 | A4D/Q8D/T11G/T17P/A324V/L428V/R504A | ++ | ++ | ++ | ++ |
| 2169/2170 | A4D/Q8D/V22T/Q111K/R504A | ++ | ++ | ++ | ++ |
| 2171/2172 | A4D/T17Q/A241S/A519T/T547A | ++ | ++ | + | ++ |

TABLE 16-1-continued

Relative Activity of TAL Variants on Tyrosine Under Various Conditions (Relative to SEQ ID NO: 2114)[1]

| SEQ ID NO: (nt/aa) | Amino Acid Differences (Relative to SEQ ID NO: 2114) | 2 mM Tyr FIOPC | Protease FIOPC | pH 3.8 FIOPC | Combined pH and Protease FIOPC |
|---|---|---|---|---|---|
| 2173/2174 | T11G/K13R/R504A | ++ | ++ | ++ | ++ |
| 2175/2176 | Q8D/T11D/K13R/A324V | ++ | ++ | ++ | ++ |
| 2177/2178 | A4D/Q8R/T11D/V22T/Q111K | ++ | ++ | ++ | ++ |
| 2179/2180 | A236V | ++ | ++ | + | + |
| 2181/2182 | I228M | ++ | ++ | + | + |
| 2183/2184 | H16Q | ++ | ++ | + | ++ |
| 2185/2186 | T437G | ++ | ++ | + | ++ |
| 2187/2188 | F10G | ++ | ++ | ++ | ++ |
| 2189/2190 | L316T | + | ++ | | |
| 2191/2192 | I2T | ++ | ++ | ++ | ++ |
| 2193/2194 | I228M/Q259H | ++ | ++ | + | + |
| 2195/2196 | D305E/I307N/I425V | ++ | ++ | + | + |
| 2197/2198 | V385A | ++ | ++ | + | ++ |
| 2199/2200 | T7Q | ++ | ++ | + | + |
| 2201/2202 | I2G | ++ | ++ | + | + |
| 2203/2204 | T430E | + | ++ | + | + |
| 2205/2206 | M478L | + | ++ | + | + |
| 2207/2208 | Q6G | ++ | ++ | + | + |
| 2209/2210 | V57I | ++ | ++ | + | + |
| 2211/2212 | A39S | ++ | ++ | + | + |
| 2213/2214 | I425V | ++ | ++ | + | + |
| 2215/2216 | H16T | ++ | + | + | + |
| 2217/2218 | T505S | + | + | + | + |
| 2219/2220 | S14G | ++ | + | + | + |

[1]All activities were determined relative to the reference polypeptide of SEQ ID NO: 2114. Levels of increased activity are defined as follows: ""+"" = 0.9 to 1.2; "++" > 1.2; and "+++" > 2.

Example 17

TAL Variants of SEQ ID NO: 2156

In this Example, experiments for evolution and screening of TAL variants derived from SEQ ID NO: 2156, for improved tyrosine activity, protease resistance, and low pH tolerance are described. Directed evolution of the TAL encoded by SEQ ID NO: 2156, was carried out by constructing libraries of variant genes. These libraries were then plated, grown, and screened using the methods described below.

HTP Activity Analysis of Clarified Lysates

HTP growth and lysis of *E. coli* cells expressing TAL variants were performed as described in Example 4. TAL variant activity on tyrosine was assayed as described in Example 4 with the following conditions: 20 μL of HTP lysate diluted 10-fold in water was assayed with 2.2 mM tyrosine for 5 min. The results of the assays are shown in Table 17-1.

HTP Activity Analysis of Clarified Lysates Pretreated with Protease and/or Acidic Buffer TAL variants were challenged with chymotrypsin and trypsin as described in Example 15. Residual activity was determined as described in Example 10. The results of this assay are shown in Table 17-1.

TAL variants were challenged with acidic buffer as described in Example 15. Residual activity was determined as described in Example 10. The results of this assay are shown in Table 17-1.

In some instances, acidic buffer-treated lysate was further challenged with protease in a combined pH and protease assay as described in Example 15, and residual activity was determined as described in Example 10. The results of this assay are shown in Table 17-1.

TABLE 17-1

Relative Activity of TAL Variants on Tyrosine Under Various Conditions (Relative to SEQ ID NO: 2156)[1]

| SEQ ID NO: (nt/aa) | Amino Acid Differences (Relative to SEQ ID NO: 2156) | 2 mM Tyr FIOPC | Protease FIOPC | pH 3.8 FIOPC | Combined pH and Protease FIOPC |
|---|---|---|---|---|---|
| 2221/2222 | Q111K/M478L | + | + | + | |
| 2223/2224 | A241S/V385A/M478L | | + | | + |
| 2225/2226 | H16Q/V57I | | + | + | + |
| 2227/2228 | V57I/Q111K/P114S | + | + | + | + |
| 2229/2230 | T437G | + | + | + | |
| 2231/2232 | H16Q/V385A/M478L/T547G | | + | | + |
| 2233/2234 | A241S/V385A/M478L/T547G | | + | | + |
| 2235/2236 | H16Q/V385A/T437G | + | ++ | + | + |
| 2237/2238 | Q111K/A241S/T437G/M478L | + | + | + | + |
| 2239/2240 | A241S/V385A | + | ++ | + | + |
| 2241/2242 | D20G/V385A/T437G/M478L/T547G | + | ++ | | + |
| 2243/2244 | V57I | + | + | + | + |

TABLE 17-1-continued

Relative Activity of TAL Variants on Tyrosine Under Various Conditions (Relative to SEQ ID NO: 2156)[1]

| SEQ ID NO: (nt/aa) | Amino Acid Differences (Relative to SEQ ID NO: 2156) | 2 mM Tyr FIOPC | Protease FIOPC | pH 3.8 FIOPC | Combined pH and Protease FIOPC |
|---|---|---|---|---|---|
| 2245/2246 | V385A | + | ++ | + | + |
| 2247/2248 | V385A/T437G/M478L/T547G | + | + | | + |
| 2249/2250 | H16Q/A241S/T437G | + | ++ | + | + |
| 2251/2252 | H16Q | ++ | ++ | + | + |
| 2253/2254 | A241S/T437G | + | ++ | + | + |
| 2255/2256 | V57I/T437G | + | + | + | + |
| 2257/2258 | H16Q/V385A | + | ++ | + | + |
| 2259/2260 | T437G/M478L | + | + | + | + |
| 2261/2262 | A4D/H16Q/V385A/M478L | + | ++ | + | + |
| 2263/2264 | A4D/V57I/Q111K/T437G | ++ | ++ | + | + |
| 2265/2266 | Q111K/P114S/R202L/Y234H/L289Q/D305Q/M313L/V324A/N332K/V336I/M410P/L432Y/T435S/Q464R/A504R/V512I/T519A/D523E/K548S/D549G | + | + | + | + |
| 2267/2268 | H16Q/Y41Q/T437G | ++ | + | + | + |
| 2269/2270 | F10G/H16Q/T437G | + | + | + | + |
| 2271/2272 | A4D/T7Q/V57I/Q111K | ++ | ++ | + | ++ |
| 2273/2274 | T7Q/V385A/T547G | + | + | + | + |
| 2275/2276 | H16Q/Y41Q/V57I/T437G/M478L | + | + | | + |
| 2277/2278 | M478L | + | + | + | + |
| 2279/2280 | A241S | ++ | + | + | + |
| 2281/2282 | H16Q/Y41Q/V57I/Q111K/V385A/T547G | + | + | | + |
| 2283/2284 | H16Q/T437G | + | + | + | + |
| 2285/2286 | A4D/T7Q/Q111K/P114S/T437G/T547G | + | + | + | + |
| 2287/2288 | V57I/Q111K/M478L/T547G | + | + | + | + |
| 2289/2290 | V385A/T437G | + | + | + | + |

[1] All activities were determined relative to the reference polypeptide of SEQ ID NO: 2156. Levels of increased activity are defined as follows: ""+"" = 0.9 to 1.2; and "++" > 1.2.

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes in the United States of America, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (2290 sequences)

SEQ ID NO: 1 - DNA, 1686 bp, Artificial Sequence
  Wild Type Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccagcggtttcggtggcatggcgaacgtggttatcaccccggacctggcgaaagagctgcagaacaacctgatgcgttatcacaaagtgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgactactataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggcgagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 2 - protein, 562 aa, Artificial Sequence
  Wild Type Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAKELQNNLMRYHKVGAGQKLSLADVRAGMLLRANSHLHGASGIRLELIQRIETFLNAGVTPHVCEFGSIGASGDLTPLAYITGALVGLNDYYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 3 - DNA, 1683 bp, Artificial Sequence
  Wild Type Tyrosine Ammonia Lyase from Chroogloeocystis siderophila
atgaacaccgttctgcagacccaagcgagcaccaacctgaacgcggacaccatcctgctgggtgatcgtaacctgaccattgacgaggtggttagcgttgcgcgtcaccgtgcgaaggtgcagatcagcaccgcggataacgtggagcaacgtatccaggcgagctgcgactacattgcggaagcggttgcgaccggtcgtccgatttatggcgtgaccagcggtttcggtggcatggcgaacgtggttatcagccgtgaatacgcggacctgctgcaacacaacctggtttggtatcacaaagtgggtgcgggccacaaactgccgctgaccgatgttcgtgcggcgatgctgctgcgtgtgaacagccacctgcacggtgcgagcggtatccgtcgtgagattgttcagcgtatggaaaccttcctgaacgcgcgtgttaccccgcacgtgccggagtacggtagcatcggtgcgagcggtgacctgaccccgctgagctacatcaccggcgcgctgattggtctggatgaacgttataaggtggactttgatggcgaggaaatcgacgcgattaccgcgctggagcgtctgggtctgccgcagctgcaactgcaggcgaaagaaggcctggcgatgatgaacggtaccagcgttatgaccggcatcgcggcgaactgcgtgtacgatacccgtctgctgatggcgctgaccatgggtgcgcacgcgctgattctgcaaggcctgaacggtaccaaccagagcttccacccgtttatccacgagctgaaaccgcacccgggtcagaaatgggcggcgagcaccatgctggatctgctggcgggcagccgtctgattcgtgaggaactggacggtacccacgaatatcgtggccaagcgccgatccaggatcgttacagcctgcgttgcctggcgcaatatatgggcccgatcgtggacggtgttgcgcaggtggcgcagcaaattgaggttgaaatgaacagcgcgaccgacaacccgctgattgatgtggagaaccaagcgagctaccacggtggcaacttcctgggccagtatatcggtatgggcatggaccacctgcgttactatattggcatgatggcgaagcacctggatgttcaaatcgcgtacctggtggcgccggagtttaacaacggtctgccggcgagcctggtgggtaacaaggaacgtatcgtgaacatgggcctgaaaggtctgcagatcaccggtaacagcattatgccgctgctgagcttctacggcaacagcattgcggatcgttacccgacccacgcggagcaatataaccagaacatcaacagccaaggttttgcggcggcgaacctgacccgtaacgcggttgaaatcttccagcaatatatggcgattgcgctgatgtttggtgttcaggcggtggatctgcgtacctacgcgtatgcgggtcactatgatgcgagcgagtgcctgagcccgaccacccgtcgtctgtatcaagcggtgcgtgaagtggttggtcagccgccgagcgcggcgcgtccgtacatctgggacgatcgtgagcagccgctggatgaacacatcgcgaaaattgcggttgacatcgcgaccgaaggcgtgattgttgcggcggtgaaggacctgctgaccaccctgaaataatga

SEQ ID NO: 4 - protein, 559 aa, Artificial Sequence
  Wild Type Tyrosine Ammonia Lyase from Chroogloeocystis siderophila
MNTVLQTQASTNLNADTILLGDRNLTIDEVVSVARHRAKVQISTADNVEQRIQASCDYIAEAVATGRPIYGVTSGFGGMANVVISREYADLLQHNLVWYHKVGAGHKLPLTDVRAAMLLRVNSHLHGASGIRREIVQRMETFLNARVTPHVPEYGSIGASGDLTPLSYITGALIGLDERYKVDFDGEEIDAITALERLGLPQLQLQAKEGLAMMNGTSVMTGIAANCVYDTRLLMALTMGAHALILQGLNGTNQSFHPFIHELKPHPGQKWAASTMLDLLAGSRLIREELDGTHEYRGQAPIQDRYSLRCLAQYMGPIVDGVAQVAQQIEVEMNSATDNPLIDVENQASYHGGNFLGQYIGMGMDHLRYYIGMMAKHLDVQIAYLVAPEFNNGLPASLVGNKERIVNMGLKGLQITGNSIMPLLSFYGNSIADRYPTHAEQYNQNINSQGFAAANLTRNAVEIFQQYMAIALMFGVQAVDLRTYAYAGHYDASECLSPTTRRLYQAVREVVGQPPSAARPYIWDDREQPLDEHIAKIAVDIATEGVIVAAVKDLLTTLK

SEQ ID NO: 5 - DNA, 1524 bp, Artificial Sequence
  Wild Type Tyrosine Ammonia Lyase from Flavobacterium johnsoniae
atgaacaccatcaacgagtatctgagcctggaggaattcgaagcgatcatttttggtaaccaaaaggtgaccattagcgatgtggttgtgaaccgtgttaacgagagcttcaactttctgaaggaattcagcggtaacaaagttatctacggcgtgaacaccggttttggcccgatggcgcagtatcgtattaaagaaagcgaccagatccaactgcagtacaacctgatccgtagccacagcagcggtaccggtaaaccgctgagcccggtgtgcgcgaaagcggcgatcctggcgcgtctgaacaccctgagcctgggtaacagcggcgttcacccgagcgtgattaacctgatgagcgagctgatcaacaaggatattaccccgctgatcttcgaacatggtggcgttggtgcgagcggtgacctggtgcaactgagccacctggcgctggttctgatcggcgagggcgaagtgttctataagggcgagcgtcgtccgaccccggaagtgtttgagattgaaggcctgaaaccgattcaggttgagatccgtgaaggtctggcgctgattaacggcaccagcgtgatgaccggtatcggcgttgtgaacgtttatcacgcgaagaaactgctggattggagcctgaaaagcagctgcgcgatcaacgagctggtgcaagcgtacgacgatcacttcagcgcggaactgaaccagaccaagcgtcacaaaggtcaacaagagatcgcgctgaagatgcgtcagaacctgagcgacagcaccctgattcgtaaacgtgaggatcacctgtacagcggtgaaaacaccgaggaaatcttcaaggagaaggttcaagaatactatagcctgcgttgcgttccgcagattctgggcccggtgctggaaaccattaacaacgttgcgagcatcctggaggacgaattcaacagcgcgaacgacaacccgatcattgatgttaagaaccaacacgtgtaccacggtggcaactttcacggtgactatatcagcctggagatggataagctgaaaatcgttattaccaagctgaccatgctggcggaacgtcagctgaactatctgctgaacagcaaaatcaacgagctgctgccgccgttcgtgaacctgggtaccctgggcttcaactttggtatgcaaggcgttcagtttaccgcgaccagcaccaccgcggaaagccaaatgctgagcaacccgatgtacgtgcacagcattccgaacaacaacgacaaccaggatatcgttagcatgggtaccaacagcgcggttattaccagcaaggtgatcgagaacgcgttcgaagtgctggcgattgagatgatcaccattgttcaagcgatcgactatctgggccagaaggataaaattagcagcgtgagcaagaaatggtacgacgagatccgtaacatcattccgaccttcaaagaagatcaagttatgtacccgtttgttcagaaggtgaaagaccacctgattaacaactaatga

SEQ ID NO: 6 - protein, 506 aa, Artificial Sequence
  Wild Type Tyrosine Ammonia Lyase from Flavobacterium johnsoniae
MNTINEYLSLEEFEAIIFGNQKVTISDVVVNRVNESFNFLKEFSGNKVIYGVNTGFGPMAQYRIKESDQIQLQYNLIRSHSSGTGKPLSPVCAKAAILARLNTLSLGNSGVHPSVINLMSELINKDITPLIFEHGGVGASGDLVQLSHLALVLIGEGEVFYKGERRPTPEVFEIEGLKPIQVEIREGLALINGTSVMTGIGVVNVYHAKKLLDWSLKSSCAINELVQAYDDHFSAELNQTKRHKGQQEIALKMRQNLSDSTLIRKREDHLYSGENTEEIFKEKVQEYYSLRCVPQILGPVLETINNVASILEDEFNSANDNPIIDVKNQHVYHGGNFHGDYISLEMDKLKIVITKLTMLAERQLNYLLNSKINELLPPFVNLGTLGFNFGMQGVQFTATSTTAESQMLSNPMYVHSIPNNNDNQDIVSMGTNSAVITSKVIENAFEVLAIEMITIVQAIDYLGQKDKISSVSKKWYDEIRNIIPTFKEDQVMYPFVQKVKDHLINN

SEQ ID NO: 7 - DNA, 2085 bp, Artificial Sequence
  Wild Type Tyrosine Ammonia Lyase from Rhodotorula glutinis
atggcgccgcgtccgaccagccagagccaggcgcgtacctgcccgaccacccaggtgacccaagttgacatcgtggagaagatgctggcggcgccgaccgacagcaccctggaactggatggttacagcctgaacctgggtgatgtggttagcgcggcgcgtaagggtcgtccggtgcgtgttaaagacagcgatgagatccgtagcaagattgataaaagcgttgaattcctgcgtagccagctgagcatgagcgtttatggtgtgaccaccggttttggtggcagcgcggacacccgtaccgaggatgcgatcagcctgcagaaagcgctgctggaacaccaactgtgcggtgtgctgccgagcagcttcgatagctttcgtctgggtcgtggcctggaaaacagcctgccgctggaagtggttcgtggtgcgatgaccattcgtgttaacagcctgacccgtggtcacagcgcggtgcgtctggtggttctggaggcgctgaccaacttcctgaaccacggcatcaccccgattgttccgctgcgtggtaccattagcgcgagcggtgatctgagcccgctgagctacattgcggcggcgattagcggtcacccggatagcaaggtgcacgtggttcacgaaggcaaggagaaaattctgtatgcgcgtgaagcgatggcgctgtttaacctggagccggtggttctgggtccgaaagaaggtctgggcctggttaacggtaccgcggtgagcgcgagcatggcgaccctggcgctgcacgacgcgcacatgctgagcctgctgagccaaagcctgaccgcgatgaccgttgaggcgatggtgggtcacgcgggcagcttccacccgtttctgcacgatgttacccgtccgcacccgacccagattgaggtggcgggtaacattcgtaagctgctggaaggcagccgtttcgcggttcaccacgaggaagaggtgaaggttaaagacgatgaaggtatcctgcgtcaggaccgttacccgctgcgtaccagcccgcaatggctgggtccgctggttagcgatctgatccatgcgcatgcggtgctgaccattgaggcgggtcagagcaccaccgacaacccgctgatcgatgttgaaaacaagaccagccaccacggtggcaacttccaagcggcggcggtggcgaacaccatggagaagacccgtctgggtctggcgcagattggcaaactgaactttacccaactgaccgagatgctgaacgcgggtatgaaccgtggcctgccgagctgcctggcggcggaagacccgagcctgagctaccactgcaaaggtctggatattgctgcggcggcgtataccagcgagctgggtcacctggcgaacccggttaccacccatgtgcagccggcggaaatggcgaaccaagcggttaacagcctggcgctgattagcgcgcgtcgtaccaccgaaagcaacgacgttctgagcctgctgctggcgacccacctgtactgcgtgctgcaagcgatcgatctgcgtgcgattgaattcgagtttaagaaacagttcggtccggcgatcgtgagcctgattgaccaacactttggtagcgcgatgaccggcagcaacctgcgtgatgaactggttgagaaggtgaacaaaaccctggcgaagcgtctggagcagaccaacagctatgacctggttccgcgttggcacgatgcgttcagctttgcggcgggcaccgtggttgaagtgctgagcagcaccagcctgagcctggcggcggttaacgcgtggaaagttgcggcggcggagagcgcgatcagcctgacccgtcaagtgcgtgaaaccttctggagcgcggcgagcaccagcagcccggcgctgagctacctgagcccgcgtacccaaattctgtatgcgttcgttcgtgaagagctgggtgtgaaggcgcgtcgtggtgacgtttttctgggcaaacaggaagtgaccatcggtagcaacgtgagcaagatctatgaagcgattaaaagcggccgtattaacaacgtgctgctgaaaatgctggcgtaatga

SEQ ID NO: 8 - protein, 693 aa, Artificial Sequence
  Wild Type Tyrosine Ammonia Lyase from Rhodotorula glutinis
MAPRPTSQSQARTCPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRAIEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 9 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgttgttatcaccccggacctggcgaaggagctgcagcataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 10 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAKELQHNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 11 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccacgggtttcggtggcatggcgaacgttgttatcaccccggacctggcgaaggagctgcagaataacctgatgcgttatcacaaaagtggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgactactataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggcgagcctggtgggtaacagcgaccgtaaagttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 12 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAKELQNNLMRYHKSGAGQKLSLADVRAGMLLRANSHLHGASGIRLELIQRIETFLNAGVTPHVCEFGSIGASGDLTPLAYITGALVGLNDYYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRKVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 13 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 14 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 15 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccacgggtttcggtggcatggcgaacgtggttatcaccccggacctggcgaaagagctgcagaacaacctgatgcgttatcacaaagtgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgactactataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtaaagttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 16 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAKELQNNLMRYHKVGAGQKLSLADVRAGMLLRANSHLHGASGIRLELIQRIETFLNAGVTPHVCEFGSIGASGDLTPLAYITGALVGLNDYYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRKVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 17 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcgaaggagctgcagaataacctgatgcgttatcacaaaagtggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgactattataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccgcctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcagtcgctggatgaacacattgcgctgatcgcggcggatatcaccagcggtggccgtattgttaaggcgatcaaccaagtggttagcatt

SEQ ID NO: 18 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAKELQNNLMRYHKSGAGQKLSLADVRAGMLLRANSHLHGASGIRLELIQRIETFLNAGVTPHVCEFGSIGASGDLTPLAYITGALVGLNDYYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPPSLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQSLDEHIALIAADITSGGRIVKAINQVVSI

SEQ ID NO: 19 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccacgggtttcggtggcatggcgaacgttgttatcaccccggacctggcggcggagctgcagaataacctgatgcgttatcacaaaagtggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgactattataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 20 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKSGAGQKLSLADVRAGMLLRANSHLHGASGIRLELIQRIETFLNAGVTPHVCEFGSIGASGDLTPLAYITGALVGLNDYYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 21 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccacgggtttcggtggcatggcgaacgttgttatcaccccggacctggcgaaagagctgcagaacaacctgatgcgttatcacaaaagtggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgactactataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 22 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAKELQNNLMRYHKSGAGQKLSLADVRAGMLLRANSHLHGASGIRLELIQRIETFLNAGVTPHVCEFGSIGASGDLTPLAYITGALVGLNDYYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 23 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccagcggtttcggtggcatggcgaacgtggttatcaccccggacctggcggcggagctgcagaataacctgatgcgttatcacaaagtgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggcgagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcagtcgctggatgaacacattgcgctgatcgcggcggatatcaccagcggtggccgtattgttaaggcgatcaaccaagtggttagcatt

SEQ ID NO: 24 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKVGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQSLDEHIALIAADITSGGRIVKAINQVVSI

SEQ ID NO: 25 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcgaaagagctgcagaacaacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcagtcgctggatgaacacattgcgctgatcgcggcggatatcaccagcggtggccgtattgttaaggcgatcaaccaagtggttagcatt

SEQ ID NO: 26 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQSLDEHIALIAADITSGGRIVKAINQVVSI

SEQ ID NO: 27 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgttgttatcaccccggacctggcggcggagctgcagaataacctgatgcgttatcacaaaagtggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcagtcgctggatgaacacattgcgctgatcgcggcggatatcaccagcggtggccgtattgttaaggcgatcaaccaagtggttagcatt

SEQ ID NO: 28 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKSGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQSLDEHIALIAADITSGGRIVKAINQVVSI

SEQ ID NO: 29 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacgaagtggcgagtgttgcgcgttatggtgcgaaggcgctgctgaccaccaaagaggaagtgctgcagaaggttaacagcagctgcgagtgggtggcgcaggcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgccctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 30 - protein, 562 aa, Artificial Sequence
  Variant of Tyrosine Ammonia Lyase from Stanieria cyanosphaera
MIIASQTQTFTSKFPHTASDSVVIVGDKPLTIDEVASVARYGAKALLTTKEEVLQKVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 31 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaggcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 32 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 33 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacaaagtggcgcaagttgcgcgttatggtgcgaaggcgctgctgaccaccaaagaggaagtgctgcagaaggttaacagcagctgcgagtgggtggcgaacgcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 34 - protein, 562 aa, Artificial Sequence
  Variant of Tyrosine Ammonia Lyase from Stanieria cyanosphaera
MIIASQTQTFTSKFPHTASDSVVIVGDKPLTIDKVAQVARYGAKALLTTKEEVLQKVNSSCEWVANAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 35 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcaagttgcgcgttatggtgcgaaggcgcgtctgaccaccaaagaggaagtgctgcagaaggttaacagcagctgcgagtgggtggcgcaagcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgccctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaagcgatcaaccaagtggttagcatt

SEQ ID NO: 36 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKARLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 37 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacaaagtggcgcaagttgcgcgttatggtgcgaaggcgctgctgaccaccaaagaggaagtgctgcagaaagttaatagcagctgcgagtgggtggcgaacgcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaagcgatcaaccaagtggttagcatt

SEQ ID NO: 38 - protein, 562 aa, Artificial Sequence
  Variant of Tyrosine Ammonia Lyase from Stanieria cyanosphaera
MIIASQTQTFTSKFPHTASDSVVIVGDKPLTIDKVAQVARYGAKALLTTKEEVLQKVNSSCEWVANAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 39 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacgaagtggcgcaagttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 40 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 41 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacaaagtggcgcaagttgcgcgttatggtgcgaaggcgctgctgaccaccaaagaggaagtgctgcagaaggttaacagcagctgcgagtgggtggcgaacgcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgccctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 42 - protein, 562 aa, Artificial Sequence
  Variant of Tyrosine Ammonia Lyase from Stanieria cyanosphaera
MIIASQTQTFTSKFPHTASDSVVIVGDKPLTIDKVAQVARYGAKALLTTKEEVLQKVNSSCEWVANAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 43 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcaagttgcgcgttatggtgcgaaggcgctgctgaccaccaaagaggaagtgctgcagaaggttaacagcagctgcgagtgggtggcgcaggcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 44 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 45 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcaagttgcgcgttatggtgcgaaggcgctgctgaccaccaaagaggaagtgctgcagggggttaatagcagctgcgagtgggtggcgcaagcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 46 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 47 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaagttgcgcgttatggtgcgaaggcgctgctgaccaccaaagaggaagtgctgcagaaggttaacagcagctgcgagtgggtggcgaacgcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcggatcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 48 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVANAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSADQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 49 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 50 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 51 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcaagttgcgcgttatggtgcgaaggcgctgctgaccaccaaagaggaagtgctgcagaaagttaatagcagctgcgagtgggtggcgaacgcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 52 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 53 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacgaagtggcgagtgttgcgcgttatggtgcgaaggcgcgtctgaccaccaaagaggaagtgctgcagaaggttaacagcagctgcgagtgggtggcgcaggcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgagtcaaatgctggagctgctggcgggcagcgccctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 54 - protein, 562 aa, Artificial Sequence
  Variant of Tyrosine Ammonia Lyase from Stanieria cyanosphaera
MIIASQTQTFTSKFPHTASDSVVIVGDKPLTIDEVASVARYGAKARLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSASQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 55 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacgaagtggcgcaggttgcgcgttatggtgcgaaggcgcgtctgaccaccaaagaggaagtgctgcagaaagttaatagcagctgcgagtgggtggcgaacgcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaagcgatcaaccaagtggttagcatt

SEQ ID NO: 56 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKARLTTKEEVLQKVNSSCEWVANAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 57 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcgtgttgcgcgttatggtgcgaaggcgcgtctgaccaccaaagaggaagtgctgcagaaggttaacagcagctgcgagtgggtggcgcaggcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaagcgatcaaccaagtggttagcatt

SEQ ID NO: 58 - protein, 562 aa, Artificial Sequence
  Variant of Tyrosine Ammonia Lyase from Stanieria cyanosphaera
MIIASQTQTFTSKFPHTASDSVVIVGDKPLTIKEVARVARYGAKARLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 59 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgacgaagtggcgcaagttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgagtcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaagcgatcaaccaagtggttagcatt

SEQ ID NO: 60 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSASQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 61 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcaagttgcgcgttatggtgcgaaggcgctgctgaccaccaaagaggaagtgctgcagggggttaatagcagctgcgagtgggtggcgcaggcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgccctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 62 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 63 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgagtgttgcgcgttatggtgcgaaggcgctgctgaccaccaaagaggaagtgctgcagaaagttaatagcagctgcgagtgggtggcgaacgcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgagtcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaagcgatcaaccaagtggttagcatt

SEQ ID NO: 64 - protein, 562 aa, Artificial Sequence
  Variant of Tyrosine Ammonia Lyase from Stanieria cyanosphaera
MIIASQTQTFTSKFPHTASDSVVIVGDKPLTIKEVASVARYGAKALLTTKEEVLQKVNSSCEWVANAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSASQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 65 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgagtcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 66 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSASQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 67 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaagttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaaccgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 68 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDNEQALDEHIALIAADITSGGRIVKAINQVVSI

SEQ ID NO: 69 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaagaagtggcgcaagttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgccctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaaccgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 70 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDNEQALDEHIALIAADITSGGRIVKAINQVVSI

SEQ ID NO: 71 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgaacgcggttgcgagcggtgaaccgatttacggcgttacctcgggtttcggtggcatggcgaacgtggttatcagtccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 72 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVANAVASGEPIYGVTSGFGGMANVVISPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 73 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaaccgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 74 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDNEQALDEHIALIAADITSGGRIVQAINQVVSI

SEQ ID NO: 75 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgcgtctgaccaccaaagaggaagtgctgcagaaggttaacagcagctgcgagtgggtggcgaacgcggttgcgagcggtgaaccgatttacggcgttacctcgggtttcggtggcatggcgaacgtggttatcactccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaaccgccgagcgaggaacgtccgtatatctggaacgacaacgagcaggcgctggatgaacacattgcgctgatcgcggcggatatcaccagcggtggccgtattgttcaagcgatcaaccaagtggttagcatt

SEQ ID NO: 76 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKARLTTKEEVLQKVNSSCEWVANAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDNEQALDEHIALIAADITSGGRIVQAINQVVSI

SEQ ID NO: 77 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgggcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 78 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGGQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 79 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaactcggaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 80 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADITSGGRIVKAINQVVSI

SEQ ID NO: 81 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 82 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANMTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 83 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgagcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 84 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATLQLYLAIKEVVGKAPSEERPYIWNDNEQALDEHIALIAADITSGGRIVKAINQVVSI

SEQ ID NO: 85 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgaaaggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 86 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 87 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgggcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaatgagcaggcgctggatgaacacattgcgctgatcgcggcggatatcaccagcggtggccgtattgttaaggcgatcaaccaagtggttagcatt

SEQ ID NO: 88 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGGQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 89 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgggcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaactcggaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 90 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGGQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANMTRRSIEIFQQYIAIALMFGVQSVDLRTKKIANHYDASQCLSPATLQLYLAIKEVVGKAPSEERPYIWNDDEQALDEHIALIAADITSGGRIVKAINQVVSI

SEQ ID NO: 91 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgaaaggtgaaccgatttacggcgttaccagtggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgggcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaatgagcaggcgctggatgaacacattgcgctgatcgcggcggatatcaccagcggtggccgtattgttaaggcgatcaaccaagtggttagcatt

SEQ ID NO: 92 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVAKGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGGQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANMTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 93 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 94 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADITSGGRIVKAINQVVSI

SEQ ID NO: 95 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggtccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccagtggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 96 - protein, 562 aa, Artificial Sequence
  Variant of Tyrosine Ammonia Lyase from Stanieria cyanosphaera
MIIASQTQTFTSKFPHTASDSVVIVGDKPLTIKKVVQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANMTRRSIEIFQQYIAIALMFGVQSVDLRTKKIANHYDASQTLSPATLQLYLAIKEVVGKAPSEERPYIWNDDEQALDEHIALIAADITSGGRIVKAINQVVSI

SEQ ID NO: 97 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggtccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccagtggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgggcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 98 - protein, 562 aa, Artificial Sequence
  Variant of Tyrosine Ammonia Lyase from Stanieria cyanosphaera
MIIASQTQTFTSKFPHTASDSVVIVGDKPLTIKKVVQVARYGAKALLTTKEEVLQKVNSSCEWVAQAVASGEPIYGVTSGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGGQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANMTRRSIEIFQQYIAIALMFGVQSVDLRTKKIANHYDASQCLSPATLQLYLAIKEVVGKAPSEERPYIWNDDEQALDEHIALIAADITSGGRIVKAINQVVSI

SEQ ID NO: 99 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttaccagtggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgagcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaactcggaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 100 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANMTRRSIEIFQQYIAIALMFGVQSVDLRTKKIANHYDASQTLSPATLQLYLAIKEVVGKAPSEERPYIWNDNEQALDEHIALIAADITSGGRIVKAINQVVSI

SEQ ID NO: 101 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgaaaggtgaaccgatttacggcgttaccagtggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgagcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 102 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVAKGEPIYGVTSGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANMTRRSIEIFQQYIAIALMFGVQSVDLRTKKIANHYDASQTLSPATLQLYLAIKEVVGKAPSEERPYIWNDDEQALDEHIALIAADITSGGRIVKAINQVVSI

SEQ ID NO: 103 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccagtggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaacaactgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 104 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQQLSPATLQLYLAIKEVVGKAPSEERPYIWNDDEQALDEHIALIAADITSGGRIVKAINQVVSI

SEQ ID NO: 105 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggtccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 106 - protein, 562 aa, Artificial Sequence
  Variant of Tyrosine Ammonia Lyase from Stanieria cyanosphaera
MIIASQTQTFTSKFPHTASDSVVIVGDKPLTIKKVVQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANMTRRSIEIFQQYIAIALMFGVQSVDLRTKKIANHYDASQTLSPATLQLYLAIKEVVGKAPSEERPYIWNDDEQALDEHIALIAADITSGGRIVKAINQVVSI

SEQ ID NO: 107 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggtccaggttgcgcgttatggtgcgaaggcgctgctgaccaccaaagaggaagtgctgcagaaggttaacagcagctgcgagtgggtggcgcaagcggttgcgaaaggtgaaccgatttacggcgttaccagtggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcaggcagcgcgctgattcgtgacgagctggatggtagccacgactacatgggcgagcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacatgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcgaggaacgtccgtatatctggaacgacaatgagcaggcgctggatgaacacattgcgctgatcgcggcggatatcaccagcggtggccgtattgttaaggcgatcaaccaagtggttagcatt

SEQ ID NO: 108 - protein, 562 aa, Artificial Sequence
  Variant of Tyrosine Ammonia Lyase from Stanieria cyanosphaera
MIIASQTQTFTSKFPHTASDSVVIVGDKPLTIKKVVQVARYGAKALLTTKEEVLQKVNSSCEWVAQAVAKGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYMGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANMTRRSIEIFQQYIAIALMFGVQSVDLRTKKIANHYDASQTLSPATLQLYLAIKEVVGKAPSEERPYIWNDNEQALDEHIALIAADITSGGRIVKAINQVVSI

SEQ ID NO: 109 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggtccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 110 - protein, 562 aa, Artificial Sequence
  Variant of Tyrosine Ammonia Lyase from Stanieria cyanosphaera
MIIASQTQTFTSKFPHTASDSVVIVGDKPLTIKKVVQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 111 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggtccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgggcagccgatccaagatcgttactcgctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaatgagcaggcgctggatgaacacattgcgctgatcgcggcggatatcaccagcggtggccgtattgttaaggcgatcaaccaagtggttagcatt

SEQ ID NO: 112 - protein, 562 aa, Artificial Sequence
  Variant of Tyrosine Ammonia Lyase from Stanieria cyanosphaera
MIIASQTQTFTSKFPHTASDSVVIVGDKPLTIKKVVQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGGQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 113 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacgatgagcaggcgctggatgaacacattgcgctgatcgcggcggatatcaccagcggtggccgtattgttaaggcgatcaaccaagtggttagcatt

SEQ ID NO: 114 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADITSGGRIVKAINQVVSI

SEQ ID NO: 115 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcccaggttgcgcgttatggtgcgaaggcgctgctgaccaccaaagaggaagtgctgcagaaggttaacagcagctgcgagtgggtggcgcaagcggttgcgagcggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 116 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 117 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccaggggtggccgtattgttaaggcgatcaaccaagtggttagcatt

SEQ ID NO: 118 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITRGGRIVKAINQVVSI

SEQ ID NO: 119 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggaggatatcaccagcggtggccgtattgttaaggcgatcaaccaagtggttagcatt

SEQ ID NO: 120 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAEDITSGGRIVKAINQVVSI

SEQ ID NO: 121 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgatgggccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 122 - protein, 562 aa, Artificial Sequence
  Variant of Tyrosine Ammonia Lyase from Stanieria cyanosphaera
MIIASQTQTFTSKFPHTASDSVVIVGDGPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 123 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcaaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 124 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAADITSGGRIVKAINQVVSI

SEQ ID NO: 125 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattaggctgatcgcggcggatatcaccagcggtggccgtattgttaaggcgatcaaccaagtggttagcatt

SEQ ID NO: 126 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIRLIAADITSGGRIVKAINQVVSI

SEQ ID NO: 127 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcgggggatatcaccagcggtggccgtattgttaaggcgatcaaccaagtggttagcatt

SEQ ID NO: 128 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAGDITSGGRIVKAINQVVSI

SEQ ID NO: 129 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatctcgagcggtggccgtattgttaaggcgatcaaccaagtggttagcatt

SEQ ID NO: 130 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADISSGGRIVKAINQVVSI

SEQ ID NO: 131 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaacgcggtggttagcatt

SEQ ID NO: 132 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINAVVSI

SEQ ID NO: 133 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcgtctgatatcaccagcggtggccgtattgttaaggcgatcaaccaagtggttagcatt

SEQ ID NO: 134 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIASDITSGGRIVKAINQVVSI

SEQ ID NO: 135 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaatatccgtatatctggaacgacaacgagcaggcgctggatgaacacattgcgctgatcgcggcggatatcaccagcggtggccgtattgttaaggcgatcaaccaagtggttagcatt

SEQ ID NO: 136 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEEYPYIWNDNEQALDEHIALIAADITSGGRIVKAINQVVSI

SEQ ID NO: 137 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagcaggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 138 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDEQDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 139 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatctgtagcggtggccgtattgttaaggcgatcaaccaagtggttagcatt

SEQ ID NO: 140 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADICSGGRIVKAINQVVSI

SEQ ID NO: 141 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcggctatcgcggcggatatcaccagcggtggccgtattgttaaggcgatcaaccaagtggttagcatt

SEQ ID NO: 142 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIAAIAADITSGGRIVKAINQVVSI

SEQ ID NO: 143 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaagtggcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 144 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKVANHYDASQCLSPATLQLYLAIKEVVGKAPSEERPYIWNDNEQALDEHIALIAADITSGGRIVKAINQVVSI

SEQ ID NO: 145 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcggtgaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 146 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSGERPYIWNDNEQALDEHIALIAADITSGGRIVKAINQVVSI

SEQ ID NO: 147 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgtcggcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 148 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVASAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 149 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcacccagggtggccgtattgttaaggcgatcaaccaagtggttagcatt

SEQ ID NO: 150 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITQGGRIVKAINQVVSI

SEQ ID NO: 151 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtgaggcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 152 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGEAPSEERPYIWNDNEQALDEHIALIAADITSGGRIVKAINQVVSI

SEQ ID NO: 153 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggagctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 154 - protein, 562 aa, Artificial Sequence
  Variant of Tyrosine Ammonia Lyase from Stanieria cyanosphaera
MIIASQTQTFTSKFPHTASDSVVIVGDKELTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 155 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgctggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcagggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 156 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSRERPYIWNDNEQALDEHIALIAADITSGGRIVKAINQVVSI

SEQ ID NO: 157 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatccagagcggtggccgtattgttaaggcgatcaaccaagtggttagcatt

SEQ ID NO: 158 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADIQSGGRIVKAINQVVSI

SEQ ID NO: 159 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccacgggtggccgtattgttaaggcgatcaaccaagtggttagcatt

SEQ ID NO: 160 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITTGGRIVKAINQVVSI

SEQ ID NO: 161 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagattattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 162 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKIIANHYDASQCLSPATLQLYLAIKEVVGKAPSEERPYIWNDNEQALDEHIALIAADITSGGRIVKAINQVVSI

SEQ ID NO: 163 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtgttgcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 164 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGVAPSEERPYIWNDNEQALDEHIALIAADITSGGRIVKAINQVVSI

SEQ ID NO: 165 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtgcagatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 166 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVQITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 167 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgttgaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 168 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSVERPYIWNDNEQALDEHIALIAADITSGGRIVKAINQVVSI

SEQ ID NO: 169 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgcggctgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 170 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALRLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 171 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttagtgcgatcaaccaagtggttagcatt

SEQ ID NO: 172 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVSAINQVVSI

SEQ ID NO: 173 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataatccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 174 - protein, 562 aa, Artificial Sequence
  Variant of Tyrosine Ammonia Lyase from Stanieria cyanosphaera
MIIASQTQTFTSKFPHTASDSVVIVGDNPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 175 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgattgtccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 176 - protein, 562 aa, Artificial Sequence
  Variant of Tyrosine Ammonia Lyase from Stanieria cyanosphaera
MIIASQTQTFTSKFPHTASDSVVIVGDCPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 177 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagctcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 178 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSSQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 179 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaacttgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 180 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKLANHYDASQCLSPATLQLYLAIKEVVGKAPSEERPYIWNDNEQALDEHIALIAADITSGGRIVKAINQVVSI

SEQ ID NO: 181 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaataaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 182 - protein, 562 aa, Artificial Sequence
  Variant of Tyrosine Ammonia Lyase from Stanieria cyanosphaera
MIIASQTQTFTSKFPHTASDSVVIVGDKPLTINKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 183 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagaggctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 184 - protein, 562 aa, Artificial Sequence
  Variant of Tyrosine Ammonia Lyase from Stanieria cyanosphaera
MIIASQTQTFTSKFPHTASDSVVIVGDKRLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 185 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgagctgatcgcggcggatatcaccagcggtggccgtattgttaaggcgatcaaccaagtggttagcatt

SEQ ID NO: 186 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIELIAADITSGGRIVKAINQVVSI

SEQ ID NO: 187 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacagccgtatatctggaacgacaacgagcaggcgctggatgaacacattgcgctgatcgcggcggatatcaccagcggtggccgtattgttaaggcgatcaaccaagtggttagcatt

SEQ ID NO: 188 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEEQPYIWNDNEQALDEHIALIAADITSGGRIVKAINQVVSI

SEQ ID NO: 189 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcgcgagcggtggccgtattgttaaggcgatcaaccaagtggttagcatt

SEQ ID NO: 190 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADIASGGRIVKAINQVVSI

SEQ ID NO: 191 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgatgggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 192 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLMGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 193 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccaagggtggccgtattgttaaggcgatcaaccaagtggttagcatt

SEQ ID NO: 194 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITKGGRIVKAINQVVSI

SEQ ID NO: 195 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagctatgaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 196 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSYERPYIWNDNEQALDEHIALIAADITSGGRIVKAINQVVSI

SEQ ID NO: 197 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggcgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 198 - protein, 562 aa, Artificial Sequence
  Variant of Tyrosine Ammonia Lyase from Stanieria cyanosphaera
MIIASQTQTFTSKFPHTASDSVVIVGDKALTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 199 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgtttatgcgatcaaccaagtggttagcatt

SEQ ID NO: 200 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVYAINQVVSI

SEQ ID NO: 201 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtgcggagcatt

SEQ ID NO: 202 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVRSI

SEQ ID NO: 203 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaaggctattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 204 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKAIANHYDASQCLSPATLQLYLAIKEVVGKAPSEERPYIWNDNEQALDEHIALIAADITSGGRIVKAINQVVSI

SEQ ID NO: 205 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaataaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 206 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTNKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 207 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgatgcgccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 208 - protein, 562 aa, Artificial Sequence
  Variant of Tyrosine Ammonia Lyase from Stanieria cyanosphaera
MIIASQTQTFTSKFPHTASDSVVIVGDAPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 209 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaagagcggtggccgtattgttaaggcgatcaaccaagtggttagcatt

SEQ ID NO: 210 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADIKSGGRIVKAINQVVSI

SEQ ID NO: 211 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaacagccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 212 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKQPSEERPYIWNDNEQALDEHIALIAADITSGGRIVKAINQVVSI

SEQ ID NO: 213 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgcggctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 214 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKARLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 215 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaagctccgtatatctggaacgacaacgagcaggcgctggatgaacacattgcgctgatcgcggcggatatcaccagcggtggccgtattgttaaggcgatcaaccaagtggttagcatt

SEQ ID NO: 216 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEEAPYIWNDNEQALDEHIALIAADITSGGRIVKAINQVVSI

SEQ ID NO: 217 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccatgtggttagcatt

SEQ ID NO: 218 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINHVVSI

SEQ ID NO: 219 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaaactccgtatatctggaacgacaacgagcaggcgctggatgaacacattgcgctgatcgcggcggatatcaccagcggtggccgtattgttaaggcgatcaaccaagtggttagcatt

SEQ ID NO: 220 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEETPYIWNDNEQALDEHIALIAADITSGGRIVKAINQVVSI

SEQ ID NO: 221 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcgtgcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 222 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVARAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 223 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggagatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 224 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVEITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 225 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcggcggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 226 - protein, 562 aa, Artificial Sequence
  Variant of Tyrosine Ammonia Lyase from Stanieria cyanosphaera
MIIASQTQTFTSKFPHTASDSVVIVGDKPLTIKKVAAVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 227 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccgctggtggccgtattgttaaggcgatcaaccaagtggttagcatt

SEQ ID NO: 228 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITAGGRIVKAINQVVSI

SEQ ID NO: 229 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtgactagcatt

SEQ ID NO: 230 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVTSI

SEQ ID NO: 231 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacagtggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 232 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHSGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 233 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaattgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 234 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKLPSEERPYIWNDNEQALDEHIALIAADITSGGRIVKAINQVVSI

SEQ ID NO: 235 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaaggtgattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 236 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKVIANHYDASQCLSPATLQLYLAIKEVVGKAPSEERPYIWNDNEQALDEHIALIAADITSGGRIVKAINQVVSI

SEQ ID NO: 237 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttcgtgcgatcaaccaagtggttagcatt

SEQ ID NO: 238 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVRAINQVVSI

SEQ ID NO: 239 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtataaggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 240 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYKAIKEVVGKAPSEERPYIWNDNEQALDEHIALIAADITSGGRIVKAINQVVSI

SEQ ID NO: 241 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcggtagcggtggccgtattgttaaggcgatcaaccaagtggttagcatt

SEQ ID NO: 242 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADIGSGGRIVKAINQVVSI

SEQ ID NO: 243 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccgggggtggccgtattgttaaggcgatcaaccaagtggttagcatt

SEQ ID NO: 244 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITGGGRIVKAINQVVSI

SEQ ID NO: 245 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaattgccgtatatctggaacgacaacgagcaggcgctggatgaacacattgcgctgatcgcggcggatatcaccagcggtggccgtattgttaaggcgatcaaccaagtggttagcatt

SEQ ID NO: 246 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEELPYIWNDNEQALDEHIALIAADITSGGRIVKAINQVVSI

SEQ ID NO: 247 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaactcggtggttagcatt

SEQ ID NO: 248 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINSVVSI

SEQ ID NO: 249 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatccggagcggtggccgtattgttaaggcgatcaaccaagtggttagcatt

SEQ ID NO: 250 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADIRSGGRIVKAINQVVSI

SEQ ID NO: 251 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcgagcaagtggttagcatt

SEQ ID NO: 252 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAIEQVVSI

SEQ ID NO: 253 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccgataaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 254 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTDKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 255 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtactccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 256 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGTPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 257 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaacgatgtggttagcatt

SEQ ID NO: 258 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINDVVSI

SEQ ID NO: 259 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtgggtagcatt

SEQ ID NO: 260 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVGSI

SEQ ID NO: 261 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggatcgtccgtatatctggaacgacaacgagcaggcgctggatgaacacattgcgctgatcgcggcggatatcaccagcggtggccgtattgttaaggcgatcaaccaagtggttagcatt

SEQ ID NO: 262 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEDRPYIWNDNEQALDEHIALIAADITSGGRIVKAINQVVSI

SEQ ID NO: 263 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggggctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 264 - protein, 562 aa, Artificial Sequence
  Variant of Tyrosine Ammonia Lyase from Stanieria cyanosphaera
MIIASQTQTFTSKFPHTASDSVVIVGDKGLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 265 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgagattcgtccgtatatctggaacgacaacgagcaggcgctggatgaacacattgcgctgatcgcggcggatatcaccagcggtggccgtattgttaaggcgatcaaccaagtggttagcatt

SEQ ID NO: 266 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEIRPYIWNDNEQALDEHIALIAADITSGGRIVKAINQVVSI

SEQ ID NO: 267 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagagccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 268 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKEPSEERPYIWNDNEQALDEHIALIAADITSGGRIVKAINQVVSI

SEQ ID NO: 269 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgagagtcgtccgtatatctggaacgacaacgagcaggcgctggatgaacacattgcgctgatcgcggcggatatcaccagcggtggccgtattgttaaggcgatcaaccaagtggttagcatt

SEQ ID NO: 270 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSESRPYIWNDNEQALDEHIALIAADITSGGRIVKAINQVVSI

SEQ ID NO: 271 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttgaggcgatcaaccaagtggttagcatt

SEQ ID NO: 272 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVEAINQVVSI

SEQ ID NO: 273 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgacgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 274 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKATLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 275 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaaattccgtatatctggaacgacaacgagcaggcgctggatgaacacattgcgctgatcgcggcggatatcaccagcggtggccgtattgttaaggcgatcaaccaagtggttagcatt

SEQ ID NO: 276 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEEIPYIWNDNEQALDEHIALIAADITSGGRIVKAINQVVSI

SEQ ID NO: 277 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacatccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 278 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEHPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 279 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtgatgagcatt

SEQ ID NO: 280 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVMSI

SEQ ID NO: 281 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcggcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 282 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIRRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 283 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagatccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 284 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKDPSEERPYIWNDNEQALDEHIALIAADITSGGRIVKAINQVVSI

SEQ ID NO: 285 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggctcgtccgtatatctggaacgacaacgagcaggcgctggatgaacacattgcgctgatcgcggcggatatcaccagcggtggccgtattgttaaggcgatcaaccaagtggttagcatt

SEQ ID NO: 286 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEARPYIWNDNEQALDEHIALIAADITSGGRIVKAINQVVSI

SEQ ID NO: 287 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgagcatcgtccgtatatctggaacgacaacgagcaggcgctggatgaacacattgcgctgatcgcggcggatatcaccagcggtggccgtattgttaaggcgatcaaccaagtggttagcatt

SEQ ID NO: 288 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEHRPYIWNDNEQALDEHIALIAADITSGGRIVKAINQVVSI

SEQ ID NO: 289 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgtcgggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 290 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLSGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 291 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgatacgccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 292 - protein, 562 aa, Artificial Sequence
  Variant of Tyrosine Ammonia Lyase from Stanieria cyanosphaera
MIIASQTQTFTSKFPHTASDSVVIVGDTPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 293 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgtggggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 294 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLWGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 295 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggtttctagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 296 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVSSGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 297 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagtcgattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 298 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKSIANHYDASQCLSPATLQLYLAIKEVVGKAPSEERPYIWNDNEQALDEHIALIAADITSGGRIVKAINQVVSI

SEQ ID NO: 299 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagtggctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 300 - protein, 562 aa, Artificial Sequence
  Variant of Tyrosine Ammonia Lyase from Stanieria cyanosphaera
MIIASQTQTFTSKFPHTASDSVVIVGDKWLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 301 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaaccgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 302 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDNEQALDEHIALIAADITSGGRIVKAINQVVSI

SEQ ID NO: 303 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcggatgttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 304 - protein, 562 aa, Artificial Sequence
  Variant of Tyrosine Ammonia Lyase from Stanieria cyanosphaera
MIIASQTQTFTSKFPHTASDSVVIVGDKPLTIKKVADVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 305 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctggggggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 306 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLGGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 307 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgggggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 308 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVGGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 309 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagcgtgttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 310 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQRVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 311 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccgcgtgcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 312 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPRALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 313 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccggatgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 314 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPDEERPYIWNDNEQALDEHIALIAADITSGGRIVKAINQVVSI

SEQ ID NO: 315 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagcacgtgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 316 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASTCLSPATLQLYLAIKEVVGKAPSEERPYIWNDNEQALDEHIALIAADITSGGRIVKAINQVVSI

SEQ ID NO: 317 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagggtgttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 318 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQGVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 319 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaggcaagtggttagcatt

SEQ ID NO: 320 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAIRQVVSI

SEQ ID NO: 321 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaagtggcgcaggttgcgcgttatggtgcgaaggcgctgctgaccaccaaagaggaagtgctgcagaaggttaacagcagctgcgagtgggtggcgcaagcggttgcgagcggtgaaccgatttacggcgttacctcgggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcgctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacagcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgaccctgcaactgtatctggcgattaaggaagtggttggtaaagcgccgagcgaggaacgtccgtatatctggaacgacaacgagcaggcgctggatgaacacattgcgctgatcgcgagggatatcaccagcggtggccgtattgttaaggcgatcaaccaagtggttagcatt

SEQ ID NO: 322 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVASGEPIYGVTSGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNSDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIARDITSGGRIVKAINQVVSI

SEQ ID NO: 323 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgatgaggtggcccaggttgcgcgttatggtgcgaaggcgctgctgaccaccaaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacgacgagcaggcgctggatgaacacattgcgctgatcgcggcggatatcaccagcggtggccgtattgttaaggcgatcaaccaagtggttagcatt

SEQ ID NO: 324 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVANAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDDEQALDEHIALIAADITSGGRIVKAINQVVSI

SEQ ID NO: 325 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgatgaggtggcccaggttgcgcgttatggtgcgaaggcgctgctgaccactaaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaaccgccgagcgaagaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 326 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDNEQALDEHIALIAADITSGGRIVKAINQVVSI

SEQ ID NO: 327 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgaacgcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtgtgccgccgagcgaagaacgtccgtatatctggaacgacaacgagcaggcgctggatgaacacattgcgctgatcgcggcggatatccagagcggtggccgtattgttaaggcgatcaaccaagtggttagcatt

SEQ ID NO: 328 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGVPPSEERPYIWNDNEQALDEHIALIAADIQSGGRIVKAINQVVSI

SEQ ID NO: 329 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaatgaggtggcccaggttgcgcgttatggtgcgaaggcgctgctgaccaataaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacgacgagcaggcgctggatgaacacattgcgctgatcgcggcggatatccagagcggtggccgtattgttcaggcgatcaaccaagtggttagcatt

SEQ ID NO: 330 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKALLTNKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADIQSGGRIVQAINQVVSI

SEQ ID NO: 331 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaccaaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacgacgagcaggcgctggatgaacacattgcgctgatcgcggcggatatcaccagcggtggccgtattgttcaggcgatcaaccaagtggttagcatt

SEQ ID NO: 332 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADITSGGRIVQAINQVVSI

SEQ ID NO: 333 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 334 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 335 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgatgaggtggcccaggttgcgcgttatggtgcgaaggcgctgctgaccaccaaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtgtgccgccgagcgaagaacgtccgtatatctggaacgacaacgagcaggcgctggatgaacacattgcgctgatcgcggcggatatccagagcggtggccgtattgttcaggcgatcaaccaagtggttagcatt

SEQ ID NO: 336 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGVPPSEERPYIWNDNEQALDEHIALIAADIQSGGRIVQAINQVVSI

SEQ ID NO: 337 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaggtggcccaggttgcgcgttatggtgcgaaggcgctgctgaccaccaaagaggaagtgctgcagaaggttaacagcagctgcgagtgggtggcgaacgcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 338 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVANAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 339 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaccaaagaggaagtgctgcagaaggttaacagcagctgcgagtgggtggcgcaagcggttgcgaaaggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggcggatatcaccagcggtggccgtattgttcaggcgatcaaccaagtggttagcatt

SEQ ID NO: 340 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAADITSGGRIVQAINQVVSI

SEQ ID NO: 341 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaccaaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 342 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAADITSGGRIVKAINQVVSI

SEQ ID NO: 343 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaggaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 344 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVKAINQVVSI

SEQ ID NO: 345 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaagaaggtggcccaggttgcgcgttatggtgcgaaggcgctgctgaccaccaaagaggaagtgctgcagaaggttaacagcagctgcgagtgggtggcgcaagcggttgcgaaaggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacgacgagcaggcgctggatgaacacattgcgctgatcgcggaggatatccagagcggtggccgtattgttaaggcgatcaaccaagtggttagcatt

SEQ ID NO: 346 - protein, 562 aa, Artificial Sequence
  Variant of Tyrosine Ammonia Lyase from Stanieria cyanosphaera
MIIASQTQTFTSKFPHTASDSVVIVGDKPLTIKKVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAEDIQSGGRIVKAINQVVSI

SEQ ID NO: 347 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgatgaggtggcccaggttgcgcgttatggtgcgaaggcgctgctgaccactaaagaggaagtgctgcagaaggttaacagcagctgcgagtgggtggcgaacgcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaaccgccgagcgaagaacgtccgtatatctggaacgacgacgagcaggcgctggatgaacacattgcgctgatcgcggcggatatcaccagcggtggccgtattgttaaggcgatcaaccaagtggttagcatt

SEQ ID NO: 348 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVANAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKPPSEERPYIWNDDEQALDEHIALIAADITSGGRIVKAINQVVSI

SEQ ID NO: 349 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaataaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacgacgagcaggcgctggatgaacacattgcactgatcgcggcggatatcaccagcggtggccgtattgttaaggcgatcaaccaagtggttagcatt

SEQ ID NO: 350 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQKVNSSCEWVANAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADITSGGRIVKAINQVVSI

SEQ ID NO: 351 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 352 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAADITSGGRIVKAINQVVSI

SEQ ID NO: 353 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataacccgctgaccatcaaggaggtggcccaggttgcgcgttatggtgcgaaggcgctgctgaccaataaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 354 - protein, 562 aa, Artificial Sequence
  Variant of Tyrosine Ammonia Lyase from Stanieria cyanosphaera
MIIASQTQTFTSKFPHTASDSVVIVGDNPLTIKEVAQVARYGAKALLTNKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAEDITSGGRIVQAINQVVSI

SEQ ID NO: 355 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgatgaggtggcccaggttgcgcgttatggtgcgaaggcgctgctgaccactaaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggcggatatcaccagcggtggccgtattgttcaggcgatcaaccaagtggttagcatt

SEQ ID NO: 356 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAADITSGGRIVQAINQVVSI

SEQ ID NO: 357 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcgatgaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacgacgagcaggcgctggatgaacacattgcgctgatcgcggcggatatcaccagcggtggccgtattgttaaggcgatcaaccaagtggttagcatt

SEQ ID NO: 358 - protein, 562 aa, Artificial Sequence
  Variant of Tyrosine Ammonia Lyase from Stanieria cyanosphaera
MIIASQTQTFTSKFPHTASDSVVIVGDKPLTIDEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDDEQALDEHIALIAADITSGGRIVKAINQVVSI

SEQ ID NO: 359 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgagtggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacaacgagcaggcgctggatgaacacattgcactgatcgcggcggatatcaccagcggtggccgtattgttcaggcgatcaaccaagtggttagcatt

SEQ ID NO: 360 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVASGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 361 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaataaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacaacgagcaggcgctggatgaacacattgcgctgatcgcggaggatatccagagcggtggccgtattgttaaggcgatcaaccaagtggttagcatt

SEQ ID NO: 362 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAEDIQSGGRIVKAINQVVSI

SEQ ID NO: 363 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacgacgagcaggcgctggatgaacacattgcgctgatcgcggcggatatcaccagcggtggccgtattgttaaggcgatcaaccaagtggttagcatt

SEQ ID NO: 364 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDDEQALDEHIALIAADITSGGRIVKAINQVVSI

SEQ ID NO: 365 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacaacgagcaggcgctggatgaacacattgcgctgatcgcggcggatatcaccagcggtggccgtattgttcaggcgatcaaccaagtggttagcatt

SEQ ID NO: 366 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAADITSGGRIVQAINQVVSI

SEQ ID NO: 367 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacaacgagcaggcgctggatgaacacattgcactgatcgcggaggatatcaccagcggtggccgtattgttaaggcgatcaaccaagtggttagcatt

SEQ ID NO: 368 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDNEQALDEHIALIAEDITSGGRIVKAINQVVSI

SEQ ID NO: 369 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaataaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcgaagaacgtccgtatatctggaacgacgacgagcaggcgctggatgaacacattgcgctgatcgcggcggatatcaccagcggtggccgtattgttcaggcgatcaaccaagtggttagcatt

SEQ ID NO: 370 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSEERPYIWNDDEQALDEHIALIAADITSGGRIVQAINQVVSI

SEQ ID NO: 371 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagcgcactgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggcggatatcaccagcggtggccgtattgttaaggcgatcaaccaagtggttagcatt

SEQ ID NO: 372 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSALIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAADITSGGRIVKAINQVVSI

SEQ ID NO: 373 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 374 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEVEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 375 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 376 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 377 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtacgaaggcgctgctgaccactaaagaggaagtgctgcagaaggttaacgcgagctgcgagtgggtggctcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 378 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGTKALLTTKEEVLQKVNASCEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 379 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcgcgtactgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 380 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDARVLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 381 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtgaaccaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 382 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVNQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEVEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 383 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggctcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagctgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 384 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQLIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 385 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtacgaaggcgctgctgaccactaaagaggaagtgctgcagaaggttaacagcagctgcgagtgggtggctcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagctgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 386 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGTKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQLIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 387 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 388 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 389 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagctgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 390 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQLIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 391 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtacgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagctgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 392 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGTKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQLIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 393 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggctcaggcggttgcgaagggtgaaccgatttacggcgttaccactggtttcggtggcatggcgaacgtggttatcaccccggacctggcggcggagctgcagaataacctgatgtggtatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagctgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 394 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMWYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQLIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 395 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagggtgttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 396 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATLQLYLAIKEVVGKAPSKERPYIWNDNEQALDEHIALIAEDITSGGRIVQAINQVVSI

SEQ ID NO: 397 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccaataaagaggaagtgctgcagggtgttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcaaagaacagccgtatatctggaacgacaacgagcaggcgctggatgaacacattgcgctgatcgcggaggatatcaccagcggtggccgtattgttcaggcgatcaaccaagtggttagcatt

SEQ ID NO: 398 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTNKEEVLQGVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATLQLYLAIKEVVGKAPSKEQPYIWNDNEQALDEHIALIAEDITSGGRIVQAINQVVSI

SEQ ID NO: 399 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 400 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 401 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccaataaagaggaagtgctgcagaaggttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacagccgtatatctggaacgacaacgagcaggcgctggatgaacacattgcgctgatcgcggaggatatcacctcgggtggccgtattgttcaggcgatcaatcaagtggttagcatt

SEQ ID NO: 402 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTNKEEVLQKVNSSCEWVAQAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKEQPYIWNDNEQALDEHIALIAEDITSGGRIVQAINQVVSI

SEQ ID NO: 403 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 404 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATLQLYLAIKEVVGKAPSKERPYIWNDNEQALDEHIALIAEDITSGGRIVQAINQVVSI

SEQ ID NO: 405 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccaataaagaggaagtgctgcagggtgttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaacccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcaaagaacagccgtatatctggaacgacaacgagcaggcgctggatgaacacattgcgctgatcgcggaggatatcaccagcggtggccgtattgttcaggcgatcaatcaagtggttagcatt

SEQ ID NO: 406 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQGVNSSCEWVANAVAKGEPIYGVTTGFGGMANVVITPDLAAELQNNLMRYHKAGAGKKLSLADVRAGMLLRANSHLHGASGIRLELIQRIETFLNAGVNPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATLQLYLAIKEVVGKAPSKEQPYIWNDNEQALDEHIALIAEDITSGGRIVQAINQVVSI

SEQ ID NO: 407 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccactaaagaggaagtgctgcagaaggttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaatcaagtggttagcatt

SEQ ID NO: 408 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTTKEEVLQKVNSSCEWVAQAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 409 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 410 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 411 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcataatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 412 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 413 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccaataaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 414 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTNKEEVLQKVNSSCEWVANAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 415 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 416 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 417 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaatgacgtggttagcatt

SEQ ID NO: 418 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINDVVSI

SEQ ID NO: 419 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccaataaagaggaagtgctgcagaaggttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 420 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQKVNSSCEWVANAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 421 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccaataaagaggaagtgctgcagggtgttaacagcagctgcgagtgggtggcgaacgcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 422 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTNKEEVLQGVNSSCEWVANAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 423 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacagccgtatatctggaacgacaacgagcaggcgctggatgaacacattgcgctgatcgcggaggatatcaccagcggtggccgtattgttcaggcgatcgaggacgtggttagcatt

SEQ ID NO: 424 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKEQPYIWNDNEQALDEHIALIAEDITSGGRIVQAIEDVVSI

SEQ ID NO: 425 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccaataaagaggaagtgctgcagggtgttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcgagcaagtggttagcatt

SEQ ID NO: 426 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTNKEEVLQGVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAIEQVVSI

SEQ ID NO: 427 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgatgttgcgcgttatggtgcgaaggcgctgctgaccactaaagaggaagtgctgcagaaggttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcctgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaacgctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcgaggacgtggttagcatt

SEQ ID NO: 428 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTTKEEVLQKVNSSCEWVAQAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFLGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATLQLYLAIKEVVGKAPSKERPYIWNDNEQALDEHIALIAEDITSGGRIVQAIEDVVSI

SEQ ID NO: 429 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccaagggtggccgtattgttcaggcgatcaatgacgtggttagcatt

SEQ ID NO: 430 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITKGGRIVQAINDVVSI

SEQ ID NO: 431 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacagccgtatatctggaacgacaacgagcaggcgctggatgaacacattgcgctgatcgcggaggatatcaccagcggtggccgtattgttcaggcgatcaaccaagtggttagcatt

SEQ ID NO: 432 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKEQPYIWNDNEQALDEHIALIAEDITSGGRIVQAINQVVSI

SEQ ID NO: 433 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagggtgttaacagcagctgcgagtgggtggcgcaagcggttgcgaagggtgaaccgatttacggcgttaccactggtttcggtggcatggcgaacgtggttatcaccccggacctggcggcggagctgcagaataacctgatgcgttatcacaaagcgggtgcgggcaaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttacgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaatcaagtggttagcatt

SEQ ID NO: 434 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNSSCEWVAQAVAKGEPIYGVTTGFGGMANVVITPDLAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 435 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagctggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaaggggctgcagatttcgggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 436 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 437 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaaactggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgtcgtaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaaggcgctgcagattgcgggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 438 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKTGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKALQIAGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 439 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaaggcgctgcagatttcgggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 440 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKALQISGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 441 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaaactggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgtcgtaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 442 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKTGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 443 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgtggtatcacaaagctggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaaggggctgcagatttcgggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 444 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMWYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 445 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctgtcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 446 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLSYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 447 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgtggtatcacaaaactggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaaggcgctgcagatttcgggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 448 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMWYHKTGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKALQISGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 449 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgtggtatcacaaagctggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtatatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 450 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMWYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 451 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttttatgaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 452 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRFMKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 453 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgtaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 454 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTLQLYLAIKEVVGKAPSKERPYIWNDNEQALDEHIALIAEDITSGGRIVQAINQVVSI

SEQ ID NO: 455 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattgctgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 456 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 457 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgttaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 458 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 459 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 460 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 461 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgttgtatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 462 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMLYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 463 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcgatggccgtattgttcaggcgatcaaccaagtggttagcatt

SEQ ID NO: 464 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSDGRIVQAINQVVSI

SEQ ID NO: 465 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagcgttgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 466 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 467 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcaatcagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 468 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGNQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 469 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacacggaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 470 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 471 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgaagccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 472 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELKPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 473 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgagtgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 474 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPSVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 475 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaagttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 476 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIEKFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 477 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 478 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 479 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtgatgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 480 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVMQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 481 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 482 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 483 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggtggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 484 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAVELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 485 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgagtatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 486 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 487 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgactgaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 488 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTATEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 489 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaaggaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 490 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNKDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 491 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcttgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 492 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPLVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 493 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctgcgtggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccctgcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 494 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLRGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATLQLYLAIKEVVGKAPSKERPYIWNDNEQALDEHIALIAEDITSGGRIVQAINQVVSI

SEQ ID NO: 495 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggacctggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatctggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgaccgttcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 496 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDLAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATVQLYLAIKEVVGKAPSKERPYIWNDNEQALDEHIALIAEDITSGGRIVQAINQVVSI

SEQ ID NO: 497 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgaatgcggttgcgaagggtgaaccgatttacggcgttaccactggtttcggtggcatggcgaacgtggttatcaccccggaccaggcggcggagctgcagaataacctgatgctgtatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 498 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVANAVAKGEPIYGVTTGFGGMANVVITPDQAAELQNNLMLYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 499 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 500 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNASCEWVAQAVAKGEPIYGVTTGFGGMANVVITPDQAAELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 501 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaataaagaggaagtgctgcagaaggttaacgcgagctgcgagtgggtggcgaatgcggttgcgaagggtgaaccgatttacggcgttaccactggtttcggtggcatggcgaacgtggttatcaccccggaccaggcggcggagctgcagaataacctgatgcgctatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 502 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQKVNASCEWVANAVAKGEPIYGVTTGFGGMANVVITPDQAAELQNNLMRYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 503 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 504 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMRYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 505 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagggtgttaactcgagctgcgagtgggtggcgaatgcggttgcgaagggtgaaccgatttacggcgttaccactggtttcggtggcatggcgaacgtggttatcaccccggaccaggcggcggagctgcagaataacctgatgcgttatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaaccctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 506 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNSSCEWVANAVAKGEPIYGVTTGFGGMANVVITPDQAAELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATRQLYLAIKEVVGKAPSKERPYIWNDNEQALDEHIALIAEDITSGGRIVQAINQVVSI

SEQ ID NO: 507 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagggtgttaacgcgagctgcgagtgggtggcgaatgcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 508 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNASCEWVANAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 509 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaactcgagctgcgagtgggtggcgcaggcggttgcgaagggtgaaccgatttacggcgttaccactggtttcggtggcatggcgaacgtggttatcaccccggaccaggcggcggagctgcagaataacctgatgctgtatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 510 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMLYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 511 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 512 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 513 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagggtgttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 514 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNASCEWVAQAVAKGEPIYGVTTGFGGMANVVITPDQAAELQNNLMRYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 515 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaataaagaggaagtgctgcagggtgttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaaccctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 516 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQGVNASCEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATRQLYLAIKEVVGKAPSKERPYIWNDNEQALDEHIALIAEDITSGGRIVQAINQVVSI

SEQ ID NO: 517 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 518 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNASCEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 519 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaaccctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 520 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATRQLYLAIKEVVGKAPSKERPYIWNDNEQALDEHIALIAEDITSGGRIVQAINQVVSI

SEQ ID NO: 521 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagggtgttaactcgagctgcgagtgggtggcgcaggcggttgcgaagggtgaaccgatttacggcgttaccactggtttcggtggcatggcgaacgtggttatcaccccggaccaggcggcggagctgcagaataacctgatgctgtatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaaccctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 522 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNSSCEWVAQAVAKGEPIYGVTTGFGGMANVVITPDQAAELQNNLMLYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQTLSPATRQLYLAIKEVVGKAPSKERPYIWNDNEQALDEHIALIAEDITSGGRIVQAINQVVSI

SEQ ID NO: 523 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgacgttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgctgtatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaaccctgagcccggcgacccgtcaactgtatctggcgattaaggaagtggttggtaaagcgccgagcaaagaacaaccgtatatctggaacgacaacgagcaggcgctggatgaacacattgcgctgatcgcggaggatatcaccagcggtggccgtattgttcaggcgatcaaccaagtggttagcatt

SEQ ID NO: 524 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTTKEEVLQKVNSSCEWVAQAVAKGEPIYGVTTGFGGMANVVITPDQAAELQNNLMLYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQTLSPATRQLYLAIKEVVGKAPSKEQPYIWNDNEQALDEHIALIAEDITSGGRIVQAINQVVSI

SEQ ID NO: 525 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagggtgttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggcaagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 526 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNASCEWVAQAVAKGEPIYGVTTGFGGMANVVITPDQAAELQNNLMRYHKAGAGKKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 527 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgctgtatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaaaccctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 528 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNASCEWVAQAVAKGEPIYGVTTGFGGMANVVITPDQAAELQNNLMLYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQTLSPATRQLYLAIKEVVGKAPSKERPYIWNDNEQALDEHIALIAEDITSGGRIVQAINQVVSI

SEQ ID NO: 529 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccaataaagaggaagtgctgcagaaggttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 530 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTNKEEVLQKVNASCEWVAQAVAKGEPIYGVTTGFGGMANVVITPDQAAELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 531 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggccgacgttgcgcgttatggtgcgaaggcgctgctgaccaataaagaggaagtgctgcagggtgttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgcgctatcacaaagcgggtgcgggccagaagctgagcctggcggatgttcgtgcgggtatgctgctgcgtgcgaacagccacctgcacggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattactggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgcccgtatatctggaacgacaacgagcaggcgctggatgaacacattgcgctgatcgcggaggatatcaccagcggtggccgtattgttcaggcgatcaaccaagtggttagcatt

SEQ ID NO: 532 - protein, 562 aa, Artificial Sequence
  Variant of Tyrosine Ammonia Lyase from Stanieria cyanosphaera
MIIASQTQTFTSKFPHTASDSVVIVGDKPLTIKEVADVARYGAKALLTNKEEVLQGVNASCEWVAQAVAKGEPIYGVTTGFGGMANVVITPDQAAELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 533 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacgcgagctgcgagtgggtggcgcaggcggttgcgaagggtgaaccgatttacggcgttaccactggtttcggtggcatggcgaacgtggttatcaccccggaccaggcggcggagctgcagaataacctgatgctgtatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattagtggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgcctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 534 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNASCEWVAQAVAKGEPIYGVTTGFGGMANVVITPDQAAELQNNLMLYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQISGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 535 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 536 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 537 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 538 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 539 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 540 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 541 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 542 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 543 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaggtggttagcatt

SEQ ID NO: 544 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 545 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 546 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 547 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 548 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 549 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaggtggttagcatt

SEQ ID NO: 550 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 551 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 552 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSDGRIVQAINQVVSI

SEQ ID NO: 553 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaggtggttagcatt

SEQ ID NO: 554 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 555 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 556 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 557 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaggtggttagcatt

SEQ ID NO: 558 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 559 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgagtgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 560 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPSVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSDGRIVQAINQVVSI

SEQ ID NO: 561 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgagtgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 562 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPSVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 563 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 564 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSDGRIVQAINQVVSI

SEQ ID NO: 565 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatccaaagcggcggccgtattgttcaggcgatcaaccaagtggttagcatt

SEQ ID NO: 566 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDIQSGGRIVQAINQVVSI

SEQ ID NO: 567 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgagtgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaggtggttagcatt

SEQ ID NO: 568 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPSVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 569 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaggtggttagcatt

SEQ ID NO: 570 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 571 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatccaaagcggcggccgtattgttcaggcgatcaaccaggtggttagcatt

SEQ ID NO: 572 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDIQSGGRIVQAINQVVSI

SEQ ID NO: 573 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcactgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgttgatcgcggaggatatcaccagcgacggccgtattgttcaggcgatcaaccaggtggttagcatt

SEQ ID NO: 574 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 575 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaggtggttagcatt

SEQ ID NO: 576 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 577 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgaccatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 578 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 579 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 580 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 581 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 582 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 583 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 584 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 585 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 586 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSDGRIVQAINQVVSI

SEQ ID NO: 587 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 588 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 589 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaacgttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgaagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatccaaagcgacggccgtattgttcaggcgatcaaccaagtggttagcatt

SEQ ID NO: 590 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAKNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDIQSDGRIVQAINQVVSI

SEQ ID NO: 591 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggcgggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 592 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 593 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 594 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSDGRIVQAINQVVSI

SEQ ID NO: 595 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggcgacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 596 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 597 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaggtggttagcatt

SEQ ID NO: 598 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 599 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaacgttcctgaacgcgggcgtgaccccgagtgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 600 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPSVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 601 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 602 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 603 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 604 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 605 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccagcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaggtggttagcatt

SEQ ID NO: 606 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLASSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 607 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgtcgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaggtggttagcatt

SEQ ID NO: 608 - protein, 562 aa, Artificial Sequence
  Variant of Tyrosine Ammonia Lyase from Stanieria cyanosphaera
MIIASQTQTFTSKFPHTASDSVVIVGDKPLSIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 609 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcggcggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaacgttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 610 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAAELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 611 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaacgttcctgaacgcgggcgtgaccccgcatgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacgtcgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatccaaagcggcggccgtattgttcaggcgatcaaccaggtggttagcatt

SEQ ID NO: 612 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNVDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDIQSGGRIVQAINQVVSI

SEQ ID NO: 613 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagcgtcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgagtgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctggccggcagccgcctgattcgtgacgagctggatggtagccacgactaccgtggcgaacagccgatccaagatcgttacagcctgcgttgcctgccgcagtataccggcccgattgcggacggtattagcgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggccacccgtcaactgtatctggcgattaaggaagtggttggtaaagcgccgagcaaagaacgtccgtatatctggaacgacaacgagcaggcgctggatgaacacattgcgctgatcgcggaggatatcaccagcggcggccgtattgttcaggcgatcaaccaagtggttagcatt

SEQ ID NO: 614 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSVEWVAQAVAKGEPIYGVTTGFGGMANVVITPDQAKELQNNLMRYHKAGAGQKLSLADVRAGMLLRANSHLHGASGIRLELIQRIETFLNAGVTPSVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLAGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATRQLYLAIKEVVGKAPSKERPYIWNDNEQALDEHIALIAEDITSGGRIVQAINQVVSI

SEQ ID NO: 615 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 616 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 617 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggccgcggttgcgcgttatggtgcgaaggcgctgctgaccactaaagaggaagtgctgcagggcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 618 - protein, 562 aa, Artificial Sequence
  Variant of Tyrosine Ammonia Lyase from Stanieria cyanosphaera
MIIASQTQTFTSKFPHTASDSVVIVGDKPLTIKEVAAVARYGAKALLTTKEEVLQGVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 619 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgatgggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacaatgagcaggcgctggatgaacacattgcgctgatcgcggaggatatcaccagcggtggccgtattgttcaggcgatcaaccaagtggttagcatt

SEQ ID NO: 620 - protein, 562 aa, Artificial Sequence
  Variant of Tyrosine Ammonia Lyase from Stanieria cyanosphaera
MIIASQTQTFTSKFPHTASDSVVIVGDKPLTIKEVVQVARYGAKALLTTKEEVLQKVNSSCEWVAQAVAKGEPIYGVTTGFGGMANVVITPDQAKELQNNLMRYHKAGAGQKLSLADVRAGMLLRANSHLMGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 621 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggccgcggttgcgcgttatggtgcgaaggcgctgctgaccactaaagaggaagtgctgcagggcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgagcctggcggatgttcgtgcgggtatgctgctgcgtgcgaacagccacctgcatggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 622 - protein, 562 aa, Artificial Sequence
  Variant of Tyrosine Ammonia Lyase from Stanieria cyanosphaera
MIIASQTQTFTSKFPHTASDSVVIVGDKPLTIKEVAAVARYGAKALLTTKEEVLQGVNASCEWVAQAVAKGEPIYGVTTGFGGMANVVITPDQAKELQNNLMLYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 623 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgatgggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 624 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQKVNSSCEWVAQAVAKGEPIYGVTTGFGGMANVVITPDQAKELQNNLMRYHKAGAGQKLSLADVRAGMLLRANSHLMGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 625 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacaatgagcaggcgctggatgaacacattgcgctgatcgcggaggatatcaccagcggtggccgtattgttcaggcgatcaaccaagtggttagcatt

SEQ ID NO: 626 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 627 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagggcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 628 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNASCEWVAQAVAKGEPIYGVTTGFGGMANVVITPDQAKELQNNLMLYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 629 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtccaagttgcgcgttatggtgcgaaggcgctgctgaccactaaagaggaagtgctgcagaaagttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacaatgagcaggcgctggatgaacacattgcgctgatcgcggaggatatcaccagcggtggccgtattgttcaggcgatcaaccaagtggttagcatt

SEQ ID NO: 630 - protein, 562 aa, Artificial Sequence
  Variant of Tyrosine Ammonia Lyase from Stanieria cyanosphaera
MIIASQTQTFTSKFPHTASDSVVIVGDKPLTIKEVVQVARYGAKALLTTKEEVLQKVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 631 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggccgcggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 632 - protein, 562 aa, Artificial Sequence
  Variant of Tyrosine Ammonia Lyase from Stanieria cyanosphaera
MIIASQTQTFTSKFPHTASDSVVIVGDKPLTIKEVAAVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 633 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtccaagttgcgcgttatggtgcgaaggcgctgctgaccactaaagaggaagtgctgcagggcgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgagcctggcggatgttcgtgcgggtatgctgctgcgtgcgaacagccacctgcatggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 634 - protein, 562 aa, Artificial Sequence
  Variant of Tyrosine Ammonia Lyase from Stanieria cyanosphaera
MIIASQTQTFTSKFPHTASDSVVIVGDKPLTIKEVVQVARYGAKALLTTKEEVLQGVNSSCEWVAQAVAKGEPIYGVTTGFGGMANVVITPDQAKELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 635 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 636 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 637 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagaaagttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 638 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQKVNSSCEWVAQAVAKGEPIYGVTTGFGGMANVVITPDQAKELQNNLMLYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 639 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacaatgagcaggcgctggatgaacacattgcgctgatcgcggaggatatcaccagcggtggccgtattgttcaggcgatcaaccaagtggttagcatt

SEQ ID NO: 640 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 641 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 642 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 643 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggccgcggttgcgcgttatggtgcgaaggcgctgctgaccactaaagaggaagtgctgcagggcgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 644 - protein, 562 aa, Artificial Sequence
  Variant of Tyrosine Ammonia Lyase from Stanieria cyanosphaera
MIIASQTQTFTSKFPHTASDSVVIVGDKPLTIKEVAAVARYGAKALLTTKEEVLQGVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 645 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgagcctggcggatgttcgtgcgggtatgctgctgcgtgcgaacagccacctgcatggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 646 - protein, 562 aa, Artificial Sequence
  Variant of Tyrosine Ammonia Lyase from Stanieria cyanosphaera
MIIASQTQTFTSKFPHTASDSVVIVGDKPLTIKEVVQVARYGAKALLTTKEEVLQKVNSSCEWVAQAVAKGEPIYGVTTGFGGMANVVITPDQAKELQNNLMLYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 647 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagaaagttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgatgggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 648 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQKVNASCEWVAQAVAKGEPIYGVTTGFGGMANVVITPDQAKELQNNLMRYHKAGAGQKLSLADVRAGMLLRANSHLMGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 649 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtccaagttgcgcgttatggtgcgaaggcgctgctgaccactaaagaggaagtgctgcagaaagttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 650 - protein, 562 aa, Artificial Sequence
  Variant of Tyrosine Ammonia Lyase from Stanieria cyanosphaera
MIIASQTQTFTSKFPHTASDSVVIVGDKPLTIKEVVQVARYGAKALLTTKEEVLQKVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 651 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagggcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 652 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQGVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 653 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggccgcggttgcgcgttatggtgcgaaggcgctgctgaccactaaagaggaagtgctgcagggcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaactgccgtatatctggaacgacgatgagcaggcgctggatgaacacattgcgctgatcgcggaggatatcaccagcggtggccgtattgttcaggcgatcaaccaagtggttagcatt

SEQ ID NO: 654 - protein, 562 aa, Artificial Sequence
  Variant of Tyrosine Ammonia Lyase from Stanieria cyanosphaera
MIIASQTQTFTSKFPHTASDSVVIVGDKPLTIKEVAAVARYGAKALLTTKEEVLQGVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKELPYIWNDDEQALDEHIALIAEDITSGGRIVQAINQVVSI

SEQ ID NO: 655 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacaatgagcaggcgctggatgaacacattgcgctgatcgcggaggatatcaccagcggtggccgtattgttcaggcgatcaaccaagtggttagcatt

SEQ ID NO: 656 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 657 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaagttgcgcgttatggtgcgaaggcgctgctgaccactaaagaggaagtgctgcagaaagttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaactgccgtatatctggaacgacgatgagcaggcgctggatgaacacattgcgctgatcgcggaggatatcaccagcggtggccgtattgttcaggcgatcaaccaagtggttagcatt

SEQ ID NO: 658 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKELPYIWNDDEQALDEHIALIAEDITSGGRIVQAINQVVSI

SEQ ID NO: 659 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtccaagttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 660 - protein, 562 aa, Artificial Sequence
  Variant of Tyrosine Ammonia Lyase from Stanieria cyanosphaera
MIIASQTQTFTSKFPHTASDSVVIVGDKPLTIKEVVQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 661 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagggcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 662 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQGVNASCEWVAQAVAKGEPIYGVTTGFGGMANVVITPDQAKELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 663 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggccgcggttgcgcgttatggtgcgaaggcgctgctgaccactaaagaggaagtgctgcagaaagttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 664 - protein, 562 aa, Artificial Sequence
  Variant of Tyrosine Ammonia Lyase from Stanieria cyanosphaera
MIIASQTQTFTSKFPHTASDSVVIVGDKPLTIKEVAAVARYGAKALLTTKEEVLQKVNASCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 665 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcatggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 666 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 667 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgatgggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacaatgagcaggcgctggatgaacacattgcgctgatcgcggaggatatcaccagcggtggccgtattgttcaggcgatcaaccaagtggttagcatt

SEQ ID NO: 668 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLMGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 669 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggtcgcggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgagcctggcggatgttcgtgcgggtatgctgctgcgtgcgaacagccacctgcatggtgcgagcggtatccgtctggagctgattcagcgtatcgtaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtatttcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagtattatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgcccgtatatctggaacgacgatgagcaggcgctggatgaacacattgcgctgatcgcggaggatatcaccagcggtggccgtattgttcaggcgatcaaccaagtggttagcatt

SEQ ID NO: 670 - protein, 562 aa, Artificial Sequence
  Variant of Tyrosine Ammonia Lyase from Stanieria cyanosphaera
MIIASQTQTFTSKFPHTASDSVVIVGDKPLTIKEVVAVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGISEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 671 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgttgaaccgagcaaagaacgtccgtatatctggaacgacaacgagcaggcgctggatgaacacattgcgctgatcgcggaggatatcaccaaggatggccgtattgttcaggcgatcaaccaagtggttagcatt

SEQ ID NO: 672 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVEPSKERPYIWNDNEQALDEHIALIAEDITKDGRIVQAINQVVSI

SEQ ID NO: 673 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgacgctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagaaccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 674 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKATLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKEPSKERPYIWNDNEQALDEHIALIAEDITSGGRIVQAINQVVSI

SEQ ID NO: 675 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgcgcctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgctggtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 676 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKARLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPLVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 677 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgacgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggacgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgttgcaccgagcaaagaacgtccgtatatctggaacgacaacgagcagtcgctggatgaacacattgcgctgatcgcggaggatatcaccaaggatggccgtattgttcaggcgatcaaccaagtggttagcatt

SEQ ID NO: 678 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKATLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKERPYIWNDNEQSLDEHIALIAEDITKDGRIVQAINQVVSI

SEQ ID NO: 679 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 680 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITSGGRIVQAINQVVSI

SEQ ID NO: 681 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgctgctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 682 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITSGGRIVQAINQVVSI

SEQ ID NO: 683 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgacgctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcaccgagcaaagaacgtccgtatatctggaacgacaacgagcaggcgctggatgaacacattgcgctgatcgcggaggatatcaccagtgatggccgtattgttcaggcgatcaaccaagtggttagcatt

SEQ ID NO: 684 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKATLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 685 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccaaggatggccgtattgttcaggcgatcaaccaagtggttagcatt

SEQ ID NO: 686 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKDGRIVQAINQVVSI

SEQ ID NO: 687 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgacgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcaccgagcaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 688 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKATLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 689 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcaccgagcaaagaacgtccgtatatctggaacgacaacgagcaggcgctggatgaacacattgcgctgatcgcggaggatatcaccagtgatggccgtattgttcaggcgatcaaccaagtggttagcatt

SEQ ID NO: 690 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 691 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgctgctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 692 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKALLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 693 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgacgctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagaaccgagcaaagaacgtccgtatatctggaacgacaacgagcaggcgctggatgaacacattgcgctgatcgcggaggatatcaccaaggatggccgtattgttcaggcgatcaaccaagtggttagcatt

SEQ ID NO: 694 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKATLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKEPSKERPYIWNDNEQALDEHIALIAEDITKDGRIVQAINQVVSI

SEQ ID NO: 695 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgacgctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcaccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 696 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKATLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 697 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgagcaaagaacgtccgtatatctggaacgacaacgagcaggcgctggatgaacacattgcgctgatcgcggaggatatcaccagtggtggccgtattgttcaggcgatcaaccaagtggttagcatt

SEQ ID NO: 698 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITSGGRIVQAINQVVSI

SEQ ID NO: 699 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgcgcctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggacgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgagcaaagaacgtccgtatatctggaacgacaacgagcaggcgctggatgaacacattgcgctgatcgcggaggatatcaccagtggtggccgtattgttcaggcgatcaaccaagtggttagcatt

SEQ ID NO: 700 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKARLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITSGGRIVQAINQVVSI

SEQ ID NO: 701 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgcgcctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagtgatggccgtattgttcaggcgatcaaccaagtggttagcatt

SEQ ID NO: 702 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKARLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 703 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 704 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITSGGRIVQAINQVVSI

SEQ ID NO: 705 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaaggaggtggcccaggttgcgcgttatggtgcgaaggcgcgcctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgttgaaccgagcaaagaacgtccgtatatctggaacgacaacgagcaggcgctggatgaacacattgcgctgatcgcggaggatatcaccaaggatggccgtattgttcaggcgatcaaccaagtggttagcatt

SEQ ID NO: 706 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKARLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVEPSKERPYIWNDNEQALDEHIALIAEDITKDGRIVQAINQVVSI

SEQ ID NO: 707 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgcgcctgaccgataaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcaccgagcaaagaacgtccgtatatctggaacgacaacgagcaggcgctggatgaacacattgcgctgatcgcggaggatatcaccagtggtggccgtattgttcaggcgatcaaccaagtggttagcatt

SEQ ID NO: 708 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKARLTDKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 709 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaaccgctgacgatcaatgaggtggcccaggttgcgcgttatggtgcgaaggcgacgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagaaccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 710 - protein, 562 aa, Artificial Sequence
  Variant of Tyrosine Ammonia Lyase from Stanieria cyanosphaera
MIIASQTQTFTSKFPHTASDSVVIVGDKPLTINEVAQVARYGAKATLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKEPSKERPYIWNDNEQALDEHIALIAEDITSGGRIVQAINQVVSI

SEQ ID NO: 711 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccactgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcggcaatcgcggaggatatcaccagcggtggccgtattgttcaggcgatcaaccaagtggttagcatt

SEQ ID NO: 712 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 713 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 714 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSI

SEQ ID NO: 715 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcgtgcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgtctgatcgcggaggatatcaccagcggtggccgtattgttcaggcgatcaaccaagtggttagcatt

SEQ ID NO: 716 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVARAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 717 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccactgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaccgtccgtatatctggaacgacaacgagcaggcgctggatgaacacattgcgctgatcgcggaggatatcaccagcggtggccgtattgttcaggcgatcaaccaagtggttagcatt

SEQ ID NO: 718 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 719 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggagctgacgatcaaggaggtggcccaggttgcgcgttatggtgcgaaggcgctgctgaccactaaagaggaagtgctgcagaaggttaacagcagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgtctgatcgcggaggatatcaccagcggtggccgtattgttcaggcgatcaatcaagtggtgagcatt

SEQ ID NO: 720 - protein, 562 aa, Artificial Sequence
  Variant of Tyrosine Ammonia Lyase from Stanieria cyanosphaera
MIIASQTQTFTSKFPHTASDSVVIVGDKELTIKEVAQVARYGAKALLTTKEEVLQKVNSSCEWVANAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 721 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaatcaagtggtgagcatt

SEQ ID NO: 722 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 723 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagcccgtccgtatatctggaacgacaacgagcaggcgctggatgaacacattgcgctgatcgcggaggatatcaccagcggtggccgtattgttcaggcgatcgaacaagtggtgagcatt

SEQ ID NO: 724 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKARPYIWNDNEQALDEHIALIAEDITSGGRIVQAIEQVVSI

SEQ ID NO: 725 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggagctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 726 - protein, 562 aa, Artificial Sequence
  Variant of Tyrosine Ammonia Lyase from Stanieria cyanosphaera
MIIASQTQTFTSKFPHTASDSVVIVGDKELTIKEVAQVARYGAKALLTTKEEVLQKVNSSCEWVAQAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 727 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggggctgacgatcaaggaggtggcccaggttgcgcgttatggtgcgaaggcgctgctgaccactaaagaggaagtgctgcagaaggttaacagcagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 728 - protein, 562 aa, Artificial Sequence
  Variant of Tyrosine Ammonia Lyase from Stanieria cyanosphaera
MIIASQTQTFTSKFPHTASDSVVIVGDKGLTIKEVAQVARYGAKALLTTKEEVLQKVNSSCEWVANAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 729 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataaggagctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaccgtccgtatatctggaacgacaacgagcaggcgctggatgaacacattgcgctgatcgcggaggatatcaccagcggtggccgtattgttcaggcgatcaaccaagtggttagcatt

SEQ ID NO: 730 - protein, 562 aa, Artificial Sequence
  Variant of Tyrosine Ammonia Lyase from Stanieria cyanosphaera
MIIASQTQTFTSKFPHTASDSVVIVGDKELTIKEVAQVARYGAKALLTTKEEVLQKVNSSCEWVAQAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 731 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgagcctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgctggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtataaggcgattaaggaagtggttggtaaagcgccggataaagcacgtccgtatatctggaacgacaacgagcaggcgctggatgaacacattgcggcaatcgcggaggatatcaccagcggtggccgtattgttcaggcgatcaatgacgtggtgagcatt

SEQ ID NO: 732 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGKKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYKAIKEVVGKAPDKARPYIWNDNEQALDEHIAAIAEDITSGGRIVQAINDVVSI

SEQ ID NO: 733 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccaactgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 734 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 735 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 736 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 737 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggaactgctgcagggcagccgcctggttcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 738 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 739 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 740 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 741 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctgcctccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 742 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLPPLELLPKEGLAMMNGTAVMTGIAANCVHDAQNLLALSLGAHALALQGLNGTNQSFHPFIHQCKPHPGQIWSAQQMLDLLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 743 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgtcgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccaactgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 744 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 745 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccgcctggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 746 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 747 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggaactgctgcagggcagccgcctggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 748 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSS

SEQ ID NO: 749 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 750 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 751 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 752 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 753 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctgtcgctgctgcagggcagccaactgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 754 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLSLLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 755 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccaactgatccgtgacgagctggatggtagccacgactaccgcggcgaagaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 756 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSQLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 757 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggaactgctgcagggcagccaactgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 758 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 759 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggaactgctgcagggcagccgcctgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 760 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSS

SEQ ID NO: 761 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccaactggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 762 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSQLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 763 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 764 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 765 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgtcgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcttgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccgcctggtccgtgacgagctggatggtagccacgactaccgcggcgaagaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 766 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVLDAQNLLALSLGAHALALQGLNGTNQSFHPFIHQCKPHPGQIWSAQQMLDLLQGSRLVRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 767 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgtcgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 768 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 769 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccaactggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 770 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSQLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 771 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggaactgctgcagggcagccgcctggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 772 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 773 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgccagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 774 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 775 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaggttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 776 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 777 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggaactgctgcagggcagccgcctggtccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 778 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSS

SEQ ID NO: 779 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgtcgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgcggcgaagaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagtttaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 780 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 781 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctgcctccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctgtcgctgctgcagggcagccaactgatccgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 782 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLPPLELLPKEGLAMMNGTAVMTGIAANCVHDAQNLLALSLGAHALALQGLNGTNQSFHPFIHQCKPHPGQIWSAQQMLSLLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 783 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgtcgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgattcgtgacgagctggatggtagccacgactaccgtggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 784 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 785 - DNA, 1686 bp, Artificial Sequence
  Variant of Tyrosine Ammonia Lyase from Stanieria cyanosphaera
atgatcattgcgagccagacccaaaccttcaccagcaaatttccgcacaccgcgagcgacagcgtggttattgtgggtgataagccgctgacgatcaaggaggtggcccaggttgcgcgttatggtgcgaaggcgctgctgaccactaaagaggaagtgctgcagaaagttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgtcgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 786 - protein, 562 aa, Artificial Sequence
  Variant of Tyrosine Ammonia Lyase from Stanieria cyanosphaera
MIIASQTQTFTSKFPHTASDSVVIVGDKPLTIKEVAQVARYGAKALLTTKEEVLQKVNSSCEWVAQAVAKGEPIYGVTTGFGGMANVVITPDQAKELQNNLMRYHKAGAGQKLSLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 787 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcgatggccgtattgttcaggcgatcaaccaagtggttagcatt

SEQ ID NO: 788 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 789 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 790 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 791 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 792 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 793 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 794 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVANAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 795 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 796 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 797 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 798 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 799 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 800 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 801 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 802 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 803 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacgatgagcaggcgctggatgaacacattgcgctgatcgcggaggatatcaccagcgatggccgtattgttcaggcgatcaaccaagtggttagcagt

SEQ ID NO: 804 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDDEQALDEHIALIAEDITSDGRIVQAINQVVSS

SEQ ID NO: 805 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcggtggccgtattgttcaggcgatcaaccaagtggttagcagt

SEQ ID NO: 806 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGQKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSS

SEQ ID NO: 807 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaacgagcaggcgctggatgaacacattgcgctgatcgcggaggatatcaccagcgatggccgtattgttcaggcgatcaaccaagtggttagcatt

SEQ ID NO: 808 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSDGRIVQAINQVVSI

SEQ ID NO: 809 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 810 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 811 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacgatgagcaggcgctggatgaacacattgcgctgatcgcggaggatatcaccagcggtggccgtattgttcaggcgatcaaccaagtggttagcagt

SEQ ID NO: 812 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNSSCEWVAQAVAKGEPIYGVTTGFGGMANVVITPDQAKELQNNLMRYHKAGAGKKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSS

SEQ ID NO: 813 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 814 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 815 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 816 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 817 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagggtgttaactcgagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 818 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQGVNSSCEWVANAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 819 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 820 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 821 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagggtgttaactcgagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 822 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQGVNSSCEWVANAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 823 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagggtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacgatgagcaggcgctggatgaacacattgcgctgatcgcggaggatatcaccagcgatggccgtattgttcaggcgatcaaccaagtggttagcatt

SEQ ID NO: 824 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQGVNASCEWVANAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 825 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcagt

SEQ ID NO: 826 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 827 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 828 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 829 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcgatggccgtattgttcaggcgatcaaccaagtggttagcatt

SEQ ID NO: 830 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 831 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 832 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 833 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 834 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 835 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaacgagcaggcgctggatgaacacattgcgctgatcgcggaggatatcaccagcgatggccgtattgttcaggcgatcaaccaagtggttagcatt

SEQ ID NO: 836 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSDGRIVQAINQVVSI

SEQ ID NO: 837 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaactcgagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcggtggccgtattgttcaggcgatcaaccaagtggttagcagt

SEQ ID NO: 838 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVANAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSS

SEQ ID NO: 839 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 840 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 841 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagggtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 842 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDDEQALDEHIALIAEDITSGGRIVQAINQVVSI

SEQ ID NO: 843 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggatctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacgatgagcaggcgctggatgaacacattgcgctgatcgcggaggatatcaccagcggtggccgtattgttcaggcgatcaaccaagtggttagcatt

SEQ ID NO: 844 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLDLLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDDEQALDEHIALIAEDITSGGRIVQAINQVVSI

SEQ ID NO: 845 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 846 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 847 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 848 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 849 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 850 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 851 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttattgtgggtgataagccgctgacgatcaaggaggtggcccaggttgcgcgttatggtgcgaaggcgctgctgaccaccaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaacgagcaggcgctggatgaacacattgcgctgatcgcggaggatatcaccagcgatggccgtattgttcaggcgatcaaccaagtggttagcagt

SEQ ID NO: 852 - protein, 562 aa, Artificial Sequence
  Variant of Tyrosine Ammonia Lyase from Stanieria cyanosphaera
MIIASQTQTFTSKSPHTASGSVVIVGDKPLTIKEVAQVARYGAKALLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSDGRIVQAINQVVSS

SEQ ID NO: 853 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 854 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 855 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 856 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 857 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttattgtgggtgataagccgctgacgatcaaggaggtggcccaggttgcgcgttatggtgcgaaggcgctgctgaccgacaaagaggaagtgctgcagggtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 858 - protein, 562 aa, Artificial Sequence
  Variant of Tyrosine Ammonia Lyase from Stanieria cyanosphaera
MIIASQTQTFTSKSPHTASGSVVIVGDKPLTIKEVAQVARYGAKALLTDKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 859 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaaccgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcgatggccgtattgttcaggcgatcaaccaagtggttagcagt

SEQ ID NO: 860 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQTALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSS

SEQ ID NO: 861 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 862 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVANAVAKGEPIYGVTTGFGGMANVVITPDQAKELQNNLMRYHKAGAGQKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 863 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 864 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 865 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaactcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcgatggccgtattgttcaggcgatcaaccaagtggttagcatt

SEQ ID NO: 866 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSDGRIVQAINQVVSI

SEQ ID NO: 867 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 868 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 869 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgtgaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaatgagcaggcgctggatgaacacattgcgctgatcgcggaggatatcaccagcgatggccgtattgttcaggcgatcaaccaagtggttagcagt

SEQ ID NO: 870 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNSSCEWVAQAVAKGEPIYGVTTGFGGMANVVITPDQAKELQNNLMRYHKAGAGKKLPLADVRAGMLLRANSHLHGASGIRLELIQRIVTFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSDGRIVQAINQVVSS

SEQ ID NO: 871 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgagaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtcaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 872 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGQAPSKERPYIWNDNEQALDEHIALIAEDITSGGRIVQAINQVVSI

SEQ ID NO: 873 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctggtccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 874 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLVRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 875 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccggataaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 876 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPDKERPYIWNDNEQALDEHIALIAEDITKGGRIVQAINQVVSI

SEQ ID NO: 877 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattcgcctgatcgcggaggatatcacctcgggtggccgtattgttcaggcgatcaaccaagtggttagcatt

SEQ ID NO: 878 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITSGGRIVQAINQVVSI

SEQ ID NO: 879 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattgcgctgatcgcggaggatatcaccagcggtggccgtattgttcaggcgatcaaccaagtggttagcatt

SEQ ID NO: 880 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 881 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 882 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIAAIAEDITKGGRIVQAINQVVSI

SEQ ID NO: 883 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 884 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 885 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 886 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 887 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 888 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 889 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 890 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 891 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 892 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 893 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcgctgatcgcggaggatatcacctcgggtggccgtattgttcaggcgatcaaccaagtggttagcatt

SEQ ID NO: 894 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 895 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattcgcctgatcgcggaggatatcaccaagggtggccgtattgttcaggcgatcaaccaagtggttagcatt

SEQ ID NO: 896 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSI

SEQ ID NO: 897 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 898 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 899 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcgctgatcgcggaggatatcaccagcggtggccgtattgttcaggcgatcaaccaagtggttagcatt

SEQ ID NO: 900 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 901 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccggataaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 902 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPDKERPYIWNDNEQALDEHIALIAEDITKGGRIVQAINQVVSI

SEQ ID NO: 903 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 904 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 905 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 906 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 907 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 908 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 909 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 910 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 911 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 912 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 913 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcgaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 914 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSEERPYIWNDNEQALDEHIALIAEDITSGGRIVQAINQVVSI

SEQ ID NO: 915 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 916 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 917 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 918 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 919 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 920 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 921 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattgcagccatcgcggaggatatcaccaagggtggccgtattgttcaggcgatcaaccaagtggttagcatt

SEQ ID NO: 922 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIAAIAEDITKGGRIVQAINQVVSI

SEQ ID NO: 923 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 924 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 925 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcgctgatcgcggaggatatcaccaagggtggccgtattgttcaggcgatcaaccaagtggttagcatt

SEQ ID NO: 926 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 927 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagatcgtccgtatatctggaacgacaacgagcaggcgctggatgaacacattgcgctgatcgcggaggatatcacctcgggtggccgtattgttcaggcgatcaaccaagtggttagcatt

SEQ ID NO: 928 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKDRPYIWNDNEQALDEHIALIAEDITSGGRIVQAINQVVSI

SEQ ID NO: 929 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 930 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 931 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 932 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 933 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 934 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 935 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcagccatcgcggaggatatcacctcgggtggccgtattgttcaggcgatcaaccaagtggttagcatt

SEQ ID NO: 936 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIAAIAEDITSGGRIVQAINQVVSI

SEQ ID NO: 937 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 938 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 939 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 940 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 941 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagatcgtccgtatatctggaacgacaacgagcaggcgctggatgaacacattgcagccatcgcggaggatatcacctcgggtggccgtattgttcaggcgatcaaccaagtggttagcatt

SEQ ID NO: 942 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKDRPYIWNDNEQALDEHIAAIAEDITSGGRIVQAINQVVSI

SEQ ID NO: 943 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattcgcctgatcgcggaggatatcaccaagggtggccgtattgttcaggcgatcaaccaagtggttagcatt

SEQ ID NO: 944 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKDRPYIWNDNEQALDEHIRLIAEDITKGGRIVQAINQVVSI

SEQ ID NO: 945 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 946 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKPPSKERPYIWNDNEQALDEHIALIAEDITKGGRIVQAINQVVSI

SEQ ID NO: 947 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattgcactgatcgcggaggatatcacctcgggtggccgtattgttcaggcgatcaaccaagtggttagcatt

SEQ ID NO: 948 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 949 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 950 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPDKERPYIWNDNEQALDEHIRLIAEDITKGGRIVQAINQVVSI

SEQ ID NO: 951 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 952 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 953 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 954 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITKGGRIVQAINQVVSI

SEQ ID NO: 955 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 956 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSI

SEQ ID NO: 957 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 958 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 959 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 960 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 961 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 962 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITKGGRIVQAINQVVSI

SEQ ID NO: 963 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 964 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIRLIAEDITKGGRIVQAINQVVSI

SEQ ID NO: 965 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 966 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 967 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 968 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 969 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattcgcctgatcgcggaggatatcaccaagggtggccgtattgttcaggcgatcaaccaagtggttagcatt

SEQ ID NO: 970 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKDRPYIWNDNEQALDEHIRLIAEDITKGGRIVQAINQVVSI

SEQ ID NO: 971 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 972 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 973 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 974 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 975 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccggataaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 976 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPDKERPYIWNDNEQALDEHIRLIAEDITSGGRIVQAINQVVSI

SEQ ID NO: 977 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 978 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 979 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 980 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 981 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 982 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 983 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 984 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 985 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 986 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 987 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 988 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 989 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 990 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIAAIAEDITKGGRIVQAINQVVSI

SEQ ID NO: 991 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattcaagaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctactgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 992 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIAAIAEDITKGGRIVQAINQVVSI

SEQ ID NO: 993 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcactgatcgcggaggatatcacctcgggtggccgtattgttcaggcgatcaaccaagtggttagcatt

SEQ ID NO: 994 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 995 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 996 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 997 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgcagagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 998 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAQSKERPYIWNDNEQALDEHIRLIAEDITSGGRIVQAINQVVSI

SEQ ID NO: 999 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 1000 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKERPYIWNDNEQALDEHIALIAEDITSGGRIVQAINQVVSI

SEQ ID NO: 1001 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1002 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1003 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1004 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITSGGRIVQAINQVVSI

SEQ ID NO: 1005 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 1006 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1007 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1008 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1009 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1010 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1011 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattgcagccatcgcggaggatatcaccaagggtggccgtattgttcaggcgatcaaccaagtggttagcatt

SEQ ID NO: 1012 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIAAIAEDITKGGRIVQAINQVVSI

SEQ ID NO: 1013 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1014 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKERPYIWNDNEQALDEHIALIAEDITKGGRIVQAINQVVSI

SEQ ID NO: 1015 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagaacgtccgtatatctggaacgacaacgagcaggcgctggatgaacacattgcactgatcgcggaggatatcacctcgggtggccgtattgttcaggcgatcaaccaagtggttagcatt

SEQ ID NO: 1016 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGVAPSKERPYIWNDNEQALDEHIALIAEDITSGGRIVQAINQVVSI

SEQ ID NO: 1017 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 1018 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 1019 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1020 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIRLIAEDITSGGRIVQAINQVVSI

SEQ ID NO: 1021 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1022 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1023 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1024 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1025 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1026 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITKGGRIVQAINQVVSI

SEQ ID NO: 1027 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 1028 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITKGGRIVQAINQVVSI

SEQ ID NO: 1029 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattgcgctgatcgcggaggatatcaccaagggtggccgtattgttcaggcgatcaaccaagtggttagcatt

SEQ ID NO: 1030 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 1031 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 1032 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 1033 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 1034 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 1035 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1036 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 1037 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1038 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1039 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1040 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIRLIAEDITSGGRIVQAINQVVSI

SEQ ID NO: 1041 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1042 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITKGGRIVQAINQVVSI

SEQ ID NO: 1043 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1044 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1045 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattcgcctgatcgcggaggatatcacctcgggtggccgtattgttcaggcgatcaaccaagtggttagcatt

SEQ ID NO: 1046 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIRLIAEDITSGGRIVQAINQVVSI

SEQ ID NO: 1047 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 1048 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 1049 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1050 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1051 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1052 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPDKERPYIWNDNEQALDEHIALIAEDITKGGRIVQAINQVVSI

SEQ ID NO: 1053 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1054 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1055 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattcaagaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 1056 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIQEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKDRPYIWNDNEQALDEHIALIAEDITKGGRIVQAINQVVSI

SEQ ID NO: 1057 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 1058 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 1059 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtacctccgtcgaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1060 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVPPSKERPYIWNDNEQALDEHIRLIAEDITSGGRIVQAINQVVSI

SEQ ID NO: 1061 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1062 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1063 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1064 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1065 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1066 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1067 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1068 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1069 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1070 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 1071 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1072 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1073 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1074 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITKGGRIVQAINQVVSI

SEQ ID NO: 1075 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1076 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1077 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaacgagcaggcgctggatgaacacattcgcctgatcgcggaggatatcacctcgggtggccgtattgttcaggcgatcaaccaagtggttagcatt

SEQ ID NO: 1078 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITSGGRIVQAINQVVSI

SEQ ID NO: 1079 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1080 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1081 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 1082 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKERPYIWNDNEQALDEHIAAIAEDITKGGRIVQAINQVVSI

SEQ ID NO: 1083 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1084 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1085 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1086 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1087 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1088 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1089 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1090 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1091 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1092 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIAAIAEDITSGGRIVQAINQVVSI

SEQ ID NO: 1093 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgaaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattcgcctgatcgcggaggatatcaccaagggtggccgtattgttcaggcgatcaaccaagtggttagcatt

SEQ ID NO: 1094 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAKAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIRLIAEDITKGGRIVQAINQVVSI

SEQ ID NO: 1095 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcactgatcgcggaggatatcacctcgggtggccgtattgttcaggcgatcaaccaagtggttagcatt

SEQ ID NO: 1096 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1097 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattcgcctgatcgcggaggatatcacctcgggtggccgtattgttcaggcgatcaaccaagtggttagcatt

SEQ ID NO: 1098 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITSGGRIVQAINQVVSI

SEQ ID NO: 1099 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1100 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1101 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1102 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1103 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1104 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITKGGRIVQAINQVVSI

SEQ ID NO: 1105 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcgctgatcgcggaggatatcaccagcggtggccgtattgttcaggcgatcaaccaagtggttagcatt

SEQ ID NO: 1106 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 1107 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1108 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1109 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1110 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1111 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 1112 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 1113 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1114 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1115 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattcgcctgatcgcggaggatatcaccaagggtggccgtattgttcaggcgatcaaccaagtggttagcatt

SEQ ID NO: 1116 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIRLIAEDITKGGRIVQAINQVVSI

SEQ ID NO: 1117 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 1118 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKERPYIWNDNEQALDEHIRLIAEDITKGGRIVQAINQVVSI

SEQ ID NO: 1119 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcgctgatcgcggaggatatcacctcgggtggccgtattgttcaggcgatcaaccaagtggttagcatt

SEQ ID NO: 1120 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 1121 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattgcgctgatcgcggaggatatcaccaagggtggccgtattgttcaggcgatcaaccaagtggttagcatt

SEQ ID NO: 1122 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITKGGRIVQAINQVVSI

SEQ ID NO: 1123 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 1124 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 1125 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcgctgatcgcggaggatatcaccaagggtggccgtattgttcaggcgatcaaccaagtggttagcatt

SEQ ID NO: 1126 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 1127 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 1128 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITKGGRIVQAINQVVSI

SEQ ID NO: 1129 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1130 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1131 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccgtcgaaagatcgtccgtatatctggaacgacaacgagcaggcgctggatgaacacattgcactgatcgcggaggatatcacctcgggtggccgtattgttcaggcgatcaaccaagtggttagcatt

SEQ ID NO: 1132 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPSKDRPYIWNDNEQALDEHIALIAEDITSGGRIVQAINQVVSI

SEQ ID NO: 1133 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1134 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 1135 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1136 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSI

SEQ ID NO: 1137 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1138 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITKGGRIVQAINQVVSI

SEQ ID NO: 1139 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtacctccgtcgaaagatcgtccgtatatctggaacgacaacgagcaggcgctggatgaacacattgcactgatcgcggaggatatcacctcgggtggccgtattgttcaggcgatcaaccaagtggttagcatt

SEQ ID NO: 1140 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGVPPSKDRPYIWNDNEQALDEHIALIAEDITSGGRIVQAINQVVSI

SEQ ID NO: 1141 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1142 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKPPSKERPYIWNDNEQALDEHIALIAEDITKGGRIVQAINQVVSI

SEQ ID NO: 1143 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1144 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 1145 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1146 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1147 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattcgcctgatcgcggaggatatcaccaagggtggccgtattgttcaggcgatcaaccaagtggttagcatt

SEQ ID NO: 1148 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIRLIAEDITKGGRIVQAINQVVSI

SEQ ID NO: 1149 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcactgatcgcggaggatatcaccaagggtggccgtattgttcaggcgatcaaccaagtggttagcatt

SEQ ID NO: 1150 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITKGGRIVQAINQVVSI

SEQ ID NO: 1151 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcacctcgggtggccgtattgttcaggcgatcaaccaagtggttagcatt

SEQ ID NO: 1152 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1153 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 1154 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSI

SEQ ID NO: 1155 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagaacgtccgtatatctggaacgacaacgagcaggcgctggatgaacacattgcagccatcgcggaggatatcaccaagggtggccgtattgttcaggcgatcaaccaagtggttagcatt

SEQ ID NO: 1156 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIAAIAEDITKGGRIVQAINQVVSI

SEQ ID NO: 1157 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtgtagctccggataaagaacgtccgtatatctggaacgacaacgagcaggcgctggatgaacacattgcgctgatcgcggaggatatcaccaagggtggccgtattgttcaggcgatcaaccaagtggttagcatt

SEQ ID NO: 1158 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGVAPDKERPYIWNDNEQALDEHIALIAEDITKGGRIVQAINQVVSI

SEQ ID NO: 1159 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1160 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 1161 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcagccatcgcggaggatatcacctcgggtggccgtattgttcaggcgatcaaccaagtggttagcatt

SEQ ID NO: 1162 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKDRPYIWNDNEQALDEHIAAIAEDITSGGRIVQAINQVVSI

SEQ ID NO: 1163 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccaagggtggccgtattgttcaggcgatcaaccaagtggttagcatt

SEQ ID NO: 1164 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSI

SEQ ID NO: 1165 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgctgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagatcgtccgtatatctggaacgacaacgagcaggcgctggatgaacacattgcactgatcgcggaggatatcaccagcggtggccgtattgttcaggcgatcaaccaagtggttagcatt

SEQ ID NO: 1166 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTTKEEVLQRVNSSCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1167 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1168 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1169 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccggataaagatcgtccgtatatctggaacgacaacgagcaggcgctggatgaacacattcgcctgatcgcggaggatatcacctcgggtggccgtattgttcaggcgatcaaccaagtggttagcatt

SEQ ID NO: 1170 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIRLIAEDITSGGRIVQAINQVVSI

SEQ ID NO: 1171 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgccgaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcagtatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagctccgtcgaaagaacgtccgtatatctggaacgacaacgagcaggcgctggatgaacacattgcagccatcgcggaggatatcacctcgggtggccgtattgttcaggcgatcaaccaagtggttagcatt

SEQ ID NO: 1172 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIAAIAEDITSGGRIVQAINQVVSI

SEQ ID NO: 1173 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaacgaggtggcccaagttgcgcgttatggtgcgaaggcgcgtctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgaggttgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaacctccgtcgaaagatcgtccgtatatctggaacgacaacgagcaggcgctggatgaacacattgcactgatcgcggaggatatcaccaagggtggccgtattgttcaggcgatcaaccaagtggttagcatt

SEQ ID NO: 1174 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKPPSKDRPYIWNDNEQALDEHIALIAEDITKGGRIVQAINQVVSI

SEQ ID NO: 1175 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgccgttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacagccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcacctcgggtggccgtattgttcaggcgatcaaccaagtggttagcatt

SEQ ID NO: 1176 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1177 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcgacggccgtattgttcaggcgatcaaccaagtggttagcatt

SEQ ID NO: 1178 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1179 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1180 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 1181 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacgatgagcaggcgctggatgaacacattgcgctgatcgcggaggatatcaccagcgacggccgtattgttcaggcgatcaaccaagtggttagcagc

SEQ ID NO: 1182 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSS

SEQ ID NO: 1183 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1184 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1185 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1186 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSI

SEQ ID NO: 1187 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggcggccgtattgttcaggcgatcaaccaagtggttagcatt

SEQ ID NO: 1188 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1189 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcgtgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1190 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSVTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1191 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1192 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1193 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 1194 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1195 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaagaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1196 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1197 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1198 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSI

SEQ ID NO: 1199 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatt

SEQ ID NO: 1200 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1201 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1202 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSI

SEQ ID NO: 1203 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcagcggccgtattgttcaggcgatcaaccaagtggttagcatt

SEQ ID NO: 1204 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSSGRIVQAINQVVSI

SEQ ID NO: 1205 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcggtggccgtattgttcaggcgatcaaccaagtggttagcatt

SEQ ID NO: 1206 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1207 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1208 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1209 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatt

SEQ ID NO: 1210 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1211 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatc

SEQ ID NO: 1212 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1213 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaagaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1214 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1215 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1216 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSDGRIVQAINQVVSI

SEQ ID NO: 1217 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacgatgagcaggcgctggatgaacacattgcgctgatcgcggaggatatcaccagcgacggccgtattgttcaggcgatcaaccaagtggttagcagc

SEQ ID NO: 1218 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSS

SEQ ID NO: 1219 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1220 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSI

SEQ ID NO: 1221 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatc

SEQ ID NO: 1222 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1223 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggcggccgtattgttcaggcgatcaaccaagtggttagcatt

SEQ ID NO: 1224 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1225 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1226 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1227 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcggtggccgtattgttcaggcgatcaaccaagtggttagcatt

SEQ ID NO: 1228 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSI

SEQ ID NO: 1229 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1230 - protein, 562 aa, Artificial Sequence; identical to SEQ ID NO: 846
  Variant of Tyrosine Ammonia Lyase from Stanieria cyanosphaera

SEQ ID NO: 1231 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1232 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSI

SEQ ID NO: 1233 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacaatgagcaggcgctggatgaacacattgcgctgatcgcggaggatatcaccagcgacggccgtattgttcaggcgatcaaccaagtggttagcatc

SEQ ID NO: 1234 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSI

SEQ ID NO: 1235 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1236 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1237 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1238 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1239 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcggtggccgtattgttcaggcgatcaaccaagtggttagcagc

SEQ ID NO: 1240 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1241 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaagaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1242 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1243 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcagc

SEQ ID NO: 1244 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSS

SEQ ID NO: 1245 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1246 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 1247 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacgatgagcaggcgctggatgaacacattgcgctgatcgcggaggatatcaccagcggcggccgtattgttcaggcgatcaaccaagtggttagcatt

SEQ ID NO: 1248 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 1249 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcgacggccgtattgttcaggcgatcaaccaagtggttagcatt

SEQ ID NO: 1250 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1251 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcgacggccgtattgttcaggcgatcaaccaagtggttagcatc

SEQ ID NO: 1252 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1253 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacgatgagcaggcgctggatgaacacattgcgctgatcgcggaggatatcaccagcgacggccgtattgttcaggcgatcaaccaagtggttagcagc

SEQ ID NO: 1254 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDDEQALDEHIALIAEDITSDGRIVQAINQVVSS

SEQ ID NO: 1255 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattcgcctgatcgcggaggatatcaccagcggcggccgtattgttcaggcgatcaaccaagtggttagcatt

SEQ ID NO: 1256 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1257 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacgatgagcaggcgctggatgaacacattgcgctgatcgcggaggatatcaccagcggcggccgtattgttcaggcgatcaaccaagtggttagcatt

SEQ ID NO: 1258 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSGGRIVQAINQVVSI

SEQ ID NO: 1259 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1260 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1261 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1262 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSDGRIVQAINQVVSI

SEQ ID NO: 1263 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1264 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSDGRIVQAINQVVSI

SEQ ID NO: 1265 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1266 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSI

SEQ ID NO: 1267 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacgatgagcaggcgctggatgaacacattgcgctgatcgcggaggatatcaccagcggcggccgtattgttcaggcgatcaaccaagtggttagcatt

SEQ ID NO: 1268 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDDEQALDEHIALIAEDITSGGRIVQAINQVVSI

SEQ ID NO: 1269 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacgatgagcaggcgctggatgaacacattgcgctgatcgcggaggatatcaccagcggcggccgtattgttcaggcgatcaaccaagtggttagcatt

SEQ ID NO: 1270 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDDEQALDEHIALIAEDITSGGRIVQAINQVVSI

SEQ ID NO: 1271 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggcggccgtattgttcaggcgatcaaccaagtggttagcatt

SEQ ID NO: 1272 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1273 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1274 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1275 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaacgagcaggcgctggatgaacacattgcgctgatcgcggaggatatcaccagcggcggccgtattgttcaggcgatcaaccaagtggttagcatt

SEQ ID NO: 1276 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1277 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcggcggccgtattgttcaggcgatcaaccaagtggttagcagc

SEQ ID NO: 1278 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSS

SEQ ID NO: 1279 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcggtggccgtattgttcaggcgatcaaccaagtggttagcagc

SEQ ID NO: 1280 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSS

SEQ ID NO: 1281 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcgacggccgtattgttcaggcgatcaaccaagtggttagcatc

SEQ ID NO: 1282 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSDGRIVQAINQVVSI

SEQ ID NO: 1283 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1284 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSDGRIVQAINQVVSI

SEQ ID NO: 1285 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1286 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSDGRIVQAINQVVSI

SEQ ID NO: 1287 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1288 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1289 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaacgagcaggcgctggatgaacacattgcgctgatcgcggaggatatcaccagcggtggccgtattgttcaggcgatcaaccaagtggttagcagc

SEQ ID NO: 1290 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSS

SEQ ID NO: 1291 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacaacgagcaggcgctggatgaacacattgcgctgatcgcggaggatatcaccagcgacggccgtattgttcaggcgatcaaccaagtggttagcatt

SEQ ID NO: 1292 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSI

SEQ ID NO: 1293 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1294 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1295 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacgatgagcaggcgctggatgaacacattgcgctgatcgcggaggatatcaccagcgacggccgtattgttcaggcgatcaaccaagtggttagcagc

SEQ ID NO: 1296 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDDEQALDEHIALIAEDITSDGRIVQAINQVVSS

SEQ ID NO: 1297 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcgacggccgtattgttcaggcgatcaaccaagtggttagcatc

SEQ ID NO: 1298 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1299 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1300 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1301 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1302 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSI

SEQ ID NO: 1303 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1304 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1305 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacgatgagcaggcgctggatgaacacattgcgctgatcgcggaggatatcaccagcgacggccgtattgttcaggcgatcaaccaagtggttagcatc

SEQ ID NO: 1306 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1307 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1308 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1309 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1310 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1311 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatt

SEQ ID NO: 1312 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1313 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggtggccgtattgttcaggcgatcaaccaagtggttagcatc

SEQ ID NO: 1314 - protein, 562 aa, Artificial Sequence; identical to SEQ ID NO: 834
  Variant of Tyrosine Ammonia Lyase from Stanieria cyanosphaera

SEQ ID NO: 1315 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacgatgagcaggcgctggatgaacacattcgcctgatcgcggaggatatcaccagcggcggccgtattgttcaggcgatcaaccaagtggttagcatt

SEQ ID NO: 1316 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIRLIAEDITSGGRIVQAINQVVSI

SEQ ID NO: 1317 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1318 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1319 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1320 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSI

SEQ ID NO: 1321 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattgcgctgatcgcggaggatatcaccagcggtggccgtattgttcaggcgatcaaccaagtggttagcatt

SEQ ID NO: 1322 - protein, 562 aa, Artificial Sequence; identical to SEQ ID NO: 1084
  Variant of Tyrosine Ammonia Lyase from Stanieria cyanosphaera

SEQ ID NO: 1323 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattcgcctgatcgcggaggatatcaccagcggtggccgtattgttcaggcgatcaaccaagtggttagcatt

SEQ ID NO: 1324 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIRLIAEDITSGGRIVQAINQVVSI

SEQ ID NO: 1325 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatt

SEQ ID NO: 1326 - protein, 562 aa, Artificial Sequence; identical to SEQ ID NO: 788
  Variant of Tyrosine Ammonia Lyase from Stanieria cyanosphaera

SEQ ID NO: 1327 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1328 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSI

SEQ ID NO: 1329 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaagaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggtggccgtattgttcaggcgatcaaccaagtggttagcatt

SEQ ID NO: 1330 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEEPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1331 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcggtggccgtattgttcaggcgatcaaccaagtggttagcatt

SEQ ID NO: 1332 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1333 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatt

SEQ ID NO: 1334 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1335 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacgatgagcaggcgctggatgaacacattgcgctgatcgcggaggatatcaccagcgacggccgtattgttcaggcgatcaaccaagtggttagcatc

SEQ ID NO: 1336 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1337 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagatcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1338 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSDGRIVQAINQVVSI

SEQ ID NO: 1339 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggtggccgtattgttcaggcgatcaaccaagtggttagcatt

SEQ ID NO: 1340 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1341 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaagaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcgacggccgtattgttcaggcgatcaaccaagtggttagcatc

SEQ ID NO: 1342 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEEPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1343 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcgacggccgtattgttcaggcgatcaaccaagtggttagcatt

SEQ ID NO: 1344 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1345 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1346 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSI

SEQ ID NO: 1347 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1348 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1349 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggtggccgtattgttcaggcgatcaaccaagtggttagcatt

SEQ ID NO: 1350 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1351 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaacgagcaggcgctggatgaacacattcgcctgatcgcggaggatatcaccagcggtggccgtattgttcaggcgatcaaccaagtggttagcatt

SEQ ID NO: 1352 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSI

SEQ ID NO: 1353 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacgatgagcaggcgctggatgaacacattgcgctgatcgcggaggatatcaccagcggcggccgtattgttcaggcgatcaaccaagtggttagcatt

SEQ ID NO: 1354 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSGGRIVQAINQVVSI

SEQ ID NO: 1355 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattgcgctgatcgcggaggatatcaccagcggtggccgtattgttcaggcgatcaaccaagtggttagcatt

SEQ ID NO: 1356 - protein, 562 aa, Artificial Sequence; identical to SEQ ID NO: 820
  Variant of Tyrosine Ammonia Lyase from Stanieria cyanosphaera

SEQ ID NO: 1357 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1358 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSI

SEQ ID NO: 1359 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgcctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacgatgagcaggcgctggatgaacacattgcgctgatcgcggaggatatcaccagcgacggccgtattgttcaggcgatcaaccaagtggttagcatt

SEQ ID NO: 1360 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDDEQALDEHIALIAEDITSDGRIVQAINQVVSI

SEQ ID NO: 1361 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcgacggccgtattgttcaggcgatcaaccaagtggttagcatt

SEQ ID NO: 1362 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSI

SEQ ID NO: 1363 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagaacgtccgtatatctggaacgacaatgagcaggcgctggatgaacacattgcgctgatcgcggaggatatcaccagcggcggccgtattgttcaggcgatcaaccaagtggttagcagc

SEQ ID NO: 1364 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1365 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacgatgagcaggcgctggatgaacacattgcgctgatcgcggaggatatcaccagcggtggccgtattgttcaggcgatcaaccaagtggttagcatc

SEQ ID NO: 1366 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDDEQALDEHIALIAEDITSGGRIVQAINQVVSI

SEQ ID NO: 1367 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1368 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSI

SEQ ID NO: 1369 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaactcgagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1370 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSDGRIVQAINQVVSI

SEQ ID NO: 1371 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1372 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSGGRIVQAINQVVSI

SEQ ID NO: 1373 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgtcgaaagagcgtccgtatatctggaacgacaatgagcaggcgctggatgaacacattcgcctgatcgcggaggatatcaccagcgacggccgtattgttcaggcgatcaaccaagtggttagcatc

SEQ ID NO: 1374 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSDGRIVQAINQVVSI

SEQ ID NO: 1375 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1376 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSDGRIVQAINQVVSI

SEQ ID NO: 1377 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagagcgtccgtatatctggaacgacaatgagcaggcgctggatgaacacattgcgctgatcgcggaggatatcaccagcgacggccgtattgttcaggcgatcaaccaagtggttagcatt

SEQ ID NO: 1378 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKERPYIWNDNEQALDEHIALIAEDITSDGRIVQAINQVVSI

SEQ ID NO: 1379 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacgatgagcaggcgctggatgaacacattcgcctgatcgcggaggatatcaccagcgacggccgtattgttcaggcgatcaaccaagtggttagcatt

SEQ ID NO: 1380 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDDEQALDEHIRLIAEDITSDGRIVQAINQVVSI

SEQ ID NO: 1381 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccaccaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccaactgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccgagcaaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1382 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSI

SEQ ID NO: 1383 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccactaaagaggaagtgctgcagcgcgttaacagcagctgcgagtgggtggcgcaggcggttgcgaagggtgaaccgatttacggcgttaccactggtttcggtggcatggcgaacgtggttatcaccccggaccaggcgaaggagctgcagaataacctgatgcgttatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccgtctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaagcgccggataaagatcgtccgtatatctggaacgacaatgagcaggcgctggatgaacacattgcgctgatcgcggaggatatcaccagcggcggccgtattgttcaggcgatcaaccaagtggttagcatt

SEQ ID NO: 1384 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTTKEEVLQRVNSSCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSRLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPDKDRPYIWNDNEQALDEHIALIAEDITSGGRIVQAINQVVSI

SEQ ID NO: 1385 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaagcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaagcgtctgggtctggagccgctggagctgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgcaacaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaacgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgcagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1386 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAQQIEIEINSVTDNPLIDVAGNASYHGGNFMGQYIGTSMDRLRYYLGLLAKHLDVQIALLTMPEFNNGLPASLVGNTERPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1387 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgcgcgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcagctgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1388 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGARALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1389 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaagcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaacgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgcagcattgaaatcttccagcaatatattgcgatcgcgctgatgtttggtgtgcaaagcgttgacctgcgtaccaagaaaattgcgaaccactacgatgcgagtcaatgtctgagcccgcgcacccgtcagctgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1390 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTERPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1391 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaagcgtctgggtctggagccgctggagctgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaaacaaatcgagattgaaatcaacagcgtgaccgacaacccgctgatcgatgttgcgaacaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagtcaatgtctgagcccgcgcacccgtcagctgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1392 - protein, 562 aa, Artificial Sequence
  Variant of Tyrosine Ammonia Lyase from Stanieria cyanosphaera
MIIASQTQTFTSKSPHTASDSVVTVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVANNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1393 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaaggaggtggcccaggttgcgcgttatggtgcgcgcgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaagctgctgggtctggagccgctggagctgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagtcaatgtctgagcccgcgcacccgtcagctgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1394 - protein, 562 aa, Artificial Sequence
  Variant of Tyrosine Ammonia Lyase from Stanieria cyanosphaera
MIIASQTQTFTSKSPHTASDSVVTVGDKPLTIKEVAQVARYGARALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1395 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaatcgtctgggtctggagccgctggagctgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgaacaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgcagcattgaaatcttccagcaatatattgcgatcgcgctgatgtttggtgtgcaaagcgttgacctgcgtaccaagaaaattgcgaaccactacgatgcgagtcaatgtctgagcccgcgcacccgtcgtctgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1396 - protein, 562 aa, Artificial Sequence
  Variant of Tyrosine Ammonia Lyase from Stanieria cyanosphaera
MIIASQTQTFTSKSPHTASDSVVTVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALNRLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVANNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRRLYLAIKEVVGKAPSKERPYIWNDNEQALDEHIALIAEDITSGGRIVQAINQVVSS

SEQ ID NO: 1397 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaagcgtctgggtctggagccgctggagctgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1398 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1399 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagtcagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1400 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSS

SEQ ID NO: 1401 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1402 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQGVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1403 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattcgcctgatcgcggaggatatcaccagtgacggccgtattgttcaggcgatcaaccaagtggttagcagt

SEQ ID NO: 1404 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSDGRIVQAINQVVSS

SEQ ID NO: 1405 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagtgacggccgtattgttcaggcgatcaaccaagtggttagcagt

SEQ ID NO: 1406 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSS

SEQ ID NO: 1407 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1408 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSS

SEQ ID NO: 1409 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1410 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1411 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgcgtctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgccctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagtggcggccgtattgttcaggcgatcaaccaagtggttagcagt

SEQ ID NO: 1412 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKARLTDKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1413 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1414 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1415 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1416 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1417 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattcgcctgatcgcggaggatatcaccagtggcggccgtattgttcaggcgatcaaccaagtggttagcagt

SEQ ID NO: 1418 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSGGRIVQAINQVVSS

SEQ ID NO: 1419 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgcgtctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgtgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagtgacggccgtattgttcaggcgatcaaccaagtggttagcagt

SEQ ID NO: 1420 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTDKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHVLALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSDGRIVQAINQVVSS

SEQ ID NO: 1421 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1422 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1423 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaagacggccgtattgttcaggcgatcaaccaagtggttagcagt

SEQ ID NO: 1424 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQGVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1425 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1426 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1427 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccaaagacggccgtattgttcaggcgatcaaccaagtggttagcagt

SEQ ID NO: 1428 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKDGRIVQAINQVVSS

SEQ ID NO: 1429 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagtggcggccgtattgttcaggcgatcaaccaagtggttagcagt

SEQ ID NO: 1430 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1431 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1432 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSS

SEQ ID NO: 1433 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1434 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1435 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1436 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1437 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagtgacggccgtattgttcaggcgatcaaccaagtggttagcagt

SEQ ID NO: 1438 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSDGRIVQAINQVVSS

SEQ ID NO: 1439 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaagacggccgtattgttcaggcgatcaaccaagtggttagcagt

SEQ ID NO: 1440 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1441 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaagacggccgtattgttcaggcgatcaaccaagtggttagcagt

SEQ ID NO: 1442 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1443 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1444 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSS

SEQ ID NO: 1445 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1446 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1447 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1448 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1449 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaagacggccgtattgttcaggcgatcaaccaagtggttagcagt

SEQ ID NO: 1450 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1451 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1452 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1453 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1454 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1455 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccagttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1456 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1457 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1458 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1459 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1460 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1461 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1462 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSS

SEQ ID NO: 1463 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1464 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1465 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagtggcggccgtattgttcaggcgatcaaccaagtggttagcagt

SEQ ID NO: 1466 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1467 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1468 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1469 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1470 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1471 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattcaggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1472 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIQEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1473 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccagtggcggccgtattgttcaggcgatcaaccaagtggttagcagt

SEQ ID NO: 1474 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITSGGRIVQAINQVVSS

SEQ ID NO: 1475 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgcgtctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1476 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKARLTDKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKGGRIVQAINQVVSS

SEQ ID NO: 1477 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattcgcctgatcgcggaggatatcaccaaagacggccgtattgttcaggcgatcaaccaagtggttagcagt

SEQ ID NO: 1478 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKDGRIVQAINQVVSS

SEQ ID NO: 1479 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccaaagacggccgtattgttcaggcgatcaaccaagtggttagcagt

SEQ ID NO: 1480 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKDGRIVQAINQVVSS

SEQ ID NO: 1481 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1482 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1483 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccagtggcggccgtattgttcaggcgatcaaccaagtggttagcagt

SEQ ID NO: 1484 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQGVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITSGGRIVQAINQVVSS

SEQ ID NO: 1485 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccaaagacggccgtattgttcaggcgatcaaccaagtggttagcagt

SEQ ID NO: 1486 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKDGRIVQAINQVVSS

SEQ ID NO: 1487 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattcaggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1488 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1489 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1490 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1491 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1492 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITKGGRIVQAINQVVSS

SEQ ID NO: 1493 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1494 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1495 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattcgcctgatcgcggaggatatcaccagtgacggccgtattgttcaggcgatcaaccaagtggttagcagt

SEQ ID NO: 1496 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIRLIAEDITSDGRIVQAINQVVSS

SEQ ID NO: 1497 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1498 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1499 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccaaagacggccgtattgttcaggcgatcaaccaagtggttagcagt

SEQ ID NO: 1500 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITKDGRIVQAINQVVSS

SEQ ID NO: 1501 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattcaggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1502 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIQEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1503 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattcaggaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccagtgacggccgtattgttcaggcgatcaaccaagtggttagcagt

SEQ ID NO: 1504 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIQEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITSDGRIVQAINQVVSS

SEQ ID NO: 1505 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1506 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1507 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaagacggccgtattgttcaggcgatcaaccaagtggttagcagt

SEQ ID NO: 1508 - protein, 562 aa, Artificial Sequence
  Variant of Tyrosine Ammonia Lyase from Stanieria cyanosphaera
MIIASQTQTFTSKSPHTASDSVVIVGDKPLTINEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1509 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagagcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1510 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1511 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgagatcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccagcggtggccgtattgttcaggcgatcaaccaagtggttagcagt

SEQ ID NO: 1512 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITSGGRIVQAINQVVSS

SEQ ID NO: 1513 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1514 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1515 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggccgctgttgcgcgttatggtgcgaaggcgctgctgaccgacaaagaggaagtgctgcagggcgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1516 - protein, 562 aa, Artificial Sequence
  Variant of Tyrosine Ammonia Lyase from Stanieria cyanosphaera
MIIASQTQTFTSKSPHTASDSVVIVGDKPLTIKEVAAVARYGAKALLTDKEEVLQGVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1517 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacgctatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1518 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNAIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1519 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgcctcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1520 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1521 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggcgctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1522 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1523 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtgtgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1524 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGVQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1525 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagctgaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1526 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQLTGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1527 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctgcgctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1528 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPAALVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1529 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaatatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1530 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1531 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccgctccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1532 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTAPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1533 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1534 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1535 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaaacgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1536 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLETLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1537 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgttaacgagcaggcgctggatgaacacattgcgctgatcgcggaggatatcaccagcggtggccgtattgttcaggcgatcaaccaagtggttagcagt

SEQ ID NO: 1538 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNVNEQALDEHIALIAEDITSGGRIVQAINQVVSS

SEQ ID NO: 1539 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcattcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1540 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSIRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1541 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccggcttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1542 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPAYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1543 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggctttaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1544 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGFKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKERPYIWNDNEQALDEHIALIAEDITSGGRIVQAINQVVSS

SEQ ID NO: 1545 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaaggaggtggcccaggttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgttcatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcggtgcctgccgcagtataccggcccgattgcggacggtattgcggaaatcgcgaagcaaatcgagattgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagaacgtccgtatatctggaacgacaacgagcaggcgctggatgaacacattgcgctgatcgcggaggatatcaccagcggtggccgtattgttcaggcgatcaaccaagtggttagcagt

SEQ ID NO: 1546 - protein, 562 aa, Artificial Sequence
  Variant of Tyrosine Ammonia Lyase from Stanieria cyanosphaera
MIIASQTQTFTSKSPHTASDSVVIVGDKPLTIKEVAQVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVHDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEIEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKERPYIWNDNEQALDEHIALIAEDITSGGRIVQAINQVVSS

SEQ ID NO: 1547 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgtgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1548 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1549 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1550 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1551 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgtgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1552 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1553 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggccctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaagatggccgtattgttcaggcgatcaaccaagtggttagcagt

SEQ ID NO: 1554 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1555 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgcgtgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaaggtggccgtattgttcaggcgatcaaccaagtggttagcagt

SEQ ID NO: 1556 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGARALLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1557 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaagatggccgtattgttcaggcgatcaaccaagtggttagcagt

SEQ ID NO: 1558 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1559 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgtgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaaggtggccgtattgttcaggcgatcaaccaagtggttagcagt

SEQ ID NO: 1560 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1561 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1562 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1563 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgcgtgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1564 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGARARLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1565 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1566 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1567 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgtgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1568 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1569 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcactgatcgcggaggatatcaccaaagatggccgtattgttcaggcgatcaaccaagtggttagcagt

SEQ ID NO: 1570 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1571 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1572 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1573 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattcgtctgatcgcggaggatatcaccaaagatggccgtattgttcaggcgatcaaccaagtggttagcagt

SEQ ID NO: 1574 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIRLIAEDITKDGRIVQAINQVVSS

SEQ ID NO: 1575 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1576 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1577 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1578 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1579 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1580 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1581 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1582 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1583 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcactgatcgcggaggatatcaccaaagatggccgtattgttcaggcgatcaaccaagtggttagcagt

SEQ ID NO: 1584 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTCQLYLAIKEVVGKAPSKDRPYIWNDNEQALDEHIALIAEDITKDGRIVQAINQVVSS

SEQ ID NO: 1585 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggccctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1586 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1587 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattcgtctgatcgcggaggatatcaccaaaggtggccgtattgttcaggcgatcaaccaagtggttagcagt

SEQ ID NO: 1588 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIRLIAEDITKGGRIVQAINQVVSS

SEQ ID NO: 1589 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1590 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1591 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1592 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1593 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1594 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1595 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1596 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1597 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1598 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1599 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggccctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaagatggccgtattgttcaggcgatcaaccaagtggttagcagt

SEQ ID NO: 1600 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1601 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgcgtgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1602 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGARARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1603 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1604 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKALLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1605 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1606 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1607 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1608 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1609 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgcgtgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgctgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggccctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1610 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGARARLTDKEEVLQRVNASCEWVAQAVAKGEPIYGVTTGFGGMANVVITPDQAKELQNNLMLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1611 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaaggtggccgtattgttcaggcgatcaaccaagtggttagcagt

SEQ ID NO: 1612 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1613 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1614 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKDGRIVQAINQVVSS

SEQ ID NO: 1615 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaacatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaaggtggccgtattgttcaggcgatcaaccaagtggttagcagt

SEQ ID NO: 1616 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLNMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIRLIAEDITKGGRIVQAINQVVSS

SEQ ID NO: 1617 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgcgtgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1618 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGARALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1619 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1620 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1621 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgtgcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1622 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1623 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1624 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1625 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggccctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1626 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1627 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1628 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKARLTDKEEVLQRVNASCEWVAQAVAKGEPIYGVTTGFGGMANVVITPDQAKELQNNLMRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1629 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1630 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1631 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgaaggcgctgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgatgcgttatcacaaagcgggtgcgggcaagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggcctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattcgtctgatcgcggaggatatcaccaaagatggccgtattgttcaggcgatcaaccaagtggttagcagt

SEQ ID NO: 1632 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGAKALLTDKEEVLQRVNASCEWVAQAVAKGEPIYGVTTGFGGMANVVITPDQAKELQNNLMRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIRLIAEDITKDGRIVQAINQVVSS

SEQ ID NO: 1633 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttattgtgggtgataagccgctgacgatcaatgaggtggccgctgttgcgcgttatggtgcgcgtgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaaggccctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgtcaactgtatctggcgattaaggaagtggttggtaaggcgccgagcaaagatcgtccgtatatctggaacgacaacgagcaggcgctggatgaacacattgcactgatcgcggaggatatcaccaaaggtggccgtattgttcaggcgatcaaccaagtggttagcagt

SEQ ID NO: 1634 - protein, 562 aa, Artificial Sequence
  Variant of Tyrosine Ammonia Lyase from Stanieria cyanosphaera
MIIASQTQTFTSKSPHTASDSVVIVGDKPLTINEVAAVARYGARARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKALQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1635 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttactgtgggtgataagccgctgacgatcaatgaggtggccgctgttgcgcgttatggtgcgcgcgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgctctgatcgcggaggatatcaccaaaggtggccgtattgttcaggcgatcaaccaagtggttagcagt

SEQ ID NO: 1636 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGARARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1637 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccactgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattcgcctgatcgcggaggatatcaccaaaggcggccgtattgttcaggcgatcaaccaagtggttagcagt

SEQ ID NO: 1638 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIRLIAEDITKGGRIVQAINQVVSS

SEQ ID NO: 1639 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1640 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1641 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccactgtatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1642 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTCQLYLAIKEVVGKAPSKDRPYIWNDNEQALDEHIALIAEDITKDGRIVQAINQVVSS

SEQ ID NO: 1643 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1644 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1645 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgcgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1646 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1647 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1648 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1649 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1650 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1651 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1652 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1653 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccactgtatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacctgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1654 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPLYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1655 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1656 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1657 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgctctgatcgcggaggatatcaccaaaggtggccgtattgttcaggcgatcaaccaagtggttagcagt

SEQ ID NO: 1658 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1659 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1660 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1661 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccactgtatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacctgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1662 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1663 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1664 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQGVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1665 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1666 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1667 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccactgtatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacctgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1668 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1669 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1670 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1671 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1672 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1673 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgctctgatcgcggaggatatcaccaaaggcggccgtattgttcaggcgatcaaccaagtggttagcagt

SEQ ID NO: 1674 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1675 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagggtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1676 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQGVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1677 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgcgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1678 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1679 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccactgtatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1680 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGAKARLTDKEEVLQRVNASCEWVAQAVAKGEPIYGVTTGFGGMANVVITPDQAKELQNNLPLYHKAGAGKKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQYYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1681 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaaggtggccgtattgttcaggcgatcaaccaagtggttagcagt

SEQ ID NO: 1682 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTRQLYLAIKEVVGKAPSKDRPYIWNDNEQALDEHIALIAEDITKGGRIVQAINQVVSS

SEQ ID NO: 1683 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaagcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcctgcgttgccagccgcagtataccggcccgattgcggacggtattgctgaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgccaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1684 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSLRCQPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1685 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggtttcggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1686 - protein, 562 aa, Artificial Sequence
  Variant of Tyrosine Ammonia Lyase from Stanieria cyanosphaera
MIIASQTQTFTSKSPHTASDSVVSVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1687 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccggctacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1688 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPATCQLYLAIKEVVGKAPSKDRPYIWNDNEQALDEHIALIAEDITKGGRIVQAINQVVSS

SEQ ID NO: 1689 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgtctgggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1690 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARLGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1691 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgttcgagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1692 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRSSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1693 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattaggctgatcgcggaggatatcaccaaaggcggccgtattgttcaggcgatcaaccaagtggttagcagt

SEQ ID NO: 1694 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIRLIAEDITKGGRIVQAINQVVSS

SEQ ID NO: 1695 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgtaatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1696 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARNGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1697 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtaatagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1698 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRNSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1699 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcttacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1700 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPLTCQLYLAIKEVVGKAPSKDRPYIWNDNEQALDEHIALIAEDITKGGRIVQAINQVVSS

SEQ ID NO: 1701 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgtcatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1702 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARHGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1703 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgaaggcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1704 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAKAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1705 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaacatgaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1706 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKHEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1707 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagagccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1708 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEEPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1709 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgtctctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1710 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKASLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1711 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacagtagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1712 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNSSCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1713 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcggaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1714 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAEARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1715 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgactgcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1716 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVATAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1717 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttaaggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1718 - protein, 562 aa, Artificial Sequence
  Variant of Tyrosine Ammonia Lyase from Stanieria cyanosphaera
MIIASQTQTFTSKSPHTASDSVVKVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1719 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1720 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1721 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgtagtggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1722 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARSGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1723 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcgggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1724 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGARARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1725 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgtcagggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1726 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARQGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1727 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctggcggacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1728 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLADKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1729 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaacatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1730 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKHRPYIWNDNEQALDEHIALIAEDITKGGRIVQAINQVVSS

SEQ ID NO: 1731 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgaatgcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1732 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1733 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtctgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1734 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1735 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacaatagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1736 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNNSCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1737 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacatggaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1738 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDMEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1739 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgtcggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1740 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGASARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1741 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaagccgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1742 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKPPSKDRPYIWNDNEQALDEHIALIAEDITKGGRIVQAINQVVSS

SEQ ID NO: 1743 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggagccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1744 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKEPSKDRPYIWNDNEQALDEHIALIAEDITKGGRIVQAINQVVSS

SEQ ID NO: 1745 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggttccaagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1746 - protein, 562 aa, Artificial Sequence
  Variant of Tyrosine Ammonia Lyase from Stanieria cyanosphaera
MIIASQTQTFTSKSPHTASDSVVTVGSKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1747 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgacggctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1748 - protein, 562 aa, Artificial Sequence
  Variant of Tyrosine Ammonia Lyase from Stanieria cyanosphaera
MIIASQTQTFTSKSPHTASDSVVTVGDKPLTINEVTAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1749 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaagaagccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1750 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKKPSKDRPYIWNDNEQALDEHIALIAEDITKGGRIVQAINQVVSS

SEQ ID NO: 1751 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgcctgcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1752 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAPARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1753 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttgaggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1754 - protein, 562 aa, Artificial Sequence
  Variant of Tyrosine Ammonia Lyase from Stanieria cyanosphaera
MIIASQTQTFTSKSPHTASDSVVEVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1755 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggttcggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1756 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGSAPSKDRPYIWNDNEQALDEHIALIAEDITKGGRIVQAINQVVSS

SEQ ID NO: 1757 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaacttctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1758 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQLLSPRTCQLYLAIKEVVGKAPSKDRPYIWNDNEQALDEHIALIAEDITKGGRIVQAINQVVSS

SEQ ID NO: 1759 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgggtgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1760 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLGDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1761 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattcatctgatcgcggaggatatcaccaaaggcggccgtattgttcaggcgatcaaccaagtggttagcagt

SEQ ID NO: 1762 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIHLIAEDITKGGRIVQAINQVVSS

SEQ ID NO: 1763 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1764 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1765 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcatgcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatacggaacgacaacgagcaggcgctggatgaacacattgcgctgatcgcggaggatatcaccaaaggcggccgtattgttcaggcgatcaaccaagtggttagcagt

SEQ ID NO: 1766 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAHAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIRNDNEQALDEHIALIAEDITKGGRIVQAINQVVSS

SEQ ID NO: 1767 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcgggaaaggcggccgtattgttcaggcgatcaaccaagtggttagcagt

SEQ ID NO: 1768 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDIGKGGRIVQAINQVVSS

SEQ ID NO: 1769 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaagactccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1770 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKTPSKDRPYIWNDNEQALDEHIALIAEDITKGGRIVQAINQVVSS

SEQ ID NO: 1771 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgtgctggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1772 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARAGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1773 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttcaggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1774 - protein, 562 aa, Artificial Sequence
  Variant of Tyrosine Ammonia Lyase from Stanieria cyanosphaera
MIIASQTQTFTSKSPHTASDSVVQVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1775 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcggcgctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1776 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKAALTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1777 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgtctcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1778 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLSRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1779 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagctgaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1780 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKAEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1781 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggtggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1782 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1783 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcgaggaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1784 - protein, 562 aa, Artificial Sequence
  Variant of Tyrosine Ammonia Lyase from Stanieria cyanosphaera
MIIASQTQTFTSKSPHTASDSVVTVGDKPLTIEEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1785 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcatgaaaggcggccgtattattcaggcgatcaaccaagtggttagcagt

SEQ ID NO: 1786 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDIMKGGRIIQAINQVVSS

SEQ ID NO: 1787 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1788 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1789 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgggaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1790 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIGKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1791 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcactgaggatatcaccaaaggcggccgtattgttcaggcgatcaaccaagtggttagcagt

SEQ ID NO: 1792 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALITEDITKGGRIVQAINQVVSS

SEQ ID NO: 1793 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgtggaggatatcaccaaaggcggccgtattgttcaggcgatcaaccaagtggttagcagt

SEQ ID NO: 1794 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIVEDITKGGRIVQAINQVVSS

SEQ ID NO: 1795 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgcttaaccaagtggttagcagt

SEQ ID NO: 1796 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQALNQVVSS

SEQ ID NO: 1797 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcagagtatcaaccaagtggttagcagt

SEQ ID NO: 1798 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQSINQVVSS

SEQ ID NO: 1799 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttcattcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1800 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFIQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1801 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaatatgttagcagt

SEQ ID NO: 1802 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQYVSS

SEQ ID NO: 1803 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccttctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1804 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSLLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1805 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaatcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1806 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1807 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccttgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtatttctcaggcgatcaaccaagtggttagcagt

SEQ ID NO: 1808 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLILDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRISQAINQVVSS

SEQ ID NO: 1809 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttcacgcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1810 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFTQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1811 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttccttggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1812 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1813 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1814 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1815 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcaccgagcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1816 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTEQLYLAIKEVVGKAPSKDRPYIWNDNEQALDEHIALIAEDITKGGRIVQAINQVVSS

SEQ ID NO: 1817 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaatgtgttagcagt

SEQ ID NO: 1818 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQCVSS

SEQ ID NO: 1819 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcggtgaaccaagtggttagcagt

SEQ ID NO: 1820 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAVNQVVSS

SEQ ID NO: 1821 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaaattgttagcagt

SEQ ID NO: 1822 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQIVSS

SEQ ID NO: 1823 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaacatgttagcagt

SEQ ID NO: 1824 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQHVSS

SEQ ID NO: 1825 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaaatggttagcagt

SEQ ID NO: 1826 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQMVSS

SEQ ID NO: 1827 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcactggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1828 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1829 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaacttgttagcagt

SEQ ID NO: 1830 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQLVSS

SEQ ID NO: 1831 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttactgcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaatatgttagcagt

SEQ ID NO: 1832 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYCMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQYVSS

SEQ ID NO: 1833 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccagaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgctgaaatcgcgaagcaaatcgaggtcgaaatcaacagcgtgaccgacaacccgctgatcgatgttgcgggtaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacgctctgaccgatcgtttcccgacccacgcggagcagttcaaccaaaacatcaacagccagggttttggcagcgcgaacctgacccgtcgtagcattgaaatcttccagcaatatattgcgatcgcgctgatgtttggtgtgcaaagcgttgacctgcgtaccaagaaaattgcgaaccactacgatgcgagccaatgtctgagcccgcgcacctgtcaactgtatctggcgattaaggaagtggttggtaaggcgccgagcaaagatcgtccgtatatctggaacgacaacgagcaggcgctggatgaacacattgcgctgatcgcggaggatatcaccaaaggcggccgtattgttcaggcgatcaaccaagtggttagcagt

SEQ ID NO: 1834 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNALTDRFPTHAEQFNQNINSQGFGSANLTRRSIEIFQQYIAIALMFGVQSVDLRTKKIANHYDASQCLSPRTCQLYLAIKEVVGKAPSKDRPYIWNDNEQALDEHIALIAEDITKGGRIVQAINQVVSS

SEQ ID NO: 1835 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1836 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1837 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttagcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1838 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFSSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1839 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgagccgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1840 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLSRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1841 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtcgttagcagt

SEQ ID NO: 1842 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1843 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1844 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1845 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaaacaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtcgttagcagt

SEQ ID NO: 1846 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1847 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaaatcgttagcagt

SEQ ID NO: 1848 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQIVSS

SEQ ID NO: 1849 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1850 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1851 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaaacaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1852 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1853 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttagcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1854 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFSSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1855 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgagccgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttagcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcactgatcgtcgaggatatcggcaaagatggccgtattgttcaggcgatcaaccaagtggttagcagt

SEQ ID NO: 1856 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLSRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFSSANLTRQSIEIFQQYIAIALMFGVQSVDLRTKKIANHYDASQCLSPRTRQLYLAIKEVVGKAPSKDRPYIWNDNEQALDEHIALIVEDIGKDGRIVQAINQVVSS

SEQ ID NO: 1857 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1858 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1859 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaaacaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1860 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1861 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaaacaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcactgatcgtcgaggatatcggcaaagatggccgtattgttcaggcgatcaaccaagtggttagcagt

SEQ ID NO: 1862 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIVEDIGKDGRIVQAINQVVSS

SEQ ID NO: 1863 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1864 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1865 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1866 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1867 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1868 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1869 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1870 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1871 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1872 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1873 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1874 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1875 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1876 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1877 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1878 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1879 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1880 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1881 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1882 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1883 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgagccgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaaatcgttagcagt

SEQ ID NO: 1884 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLSRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQIVSS

SEQ ID NO: 1885 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1886 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1887 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1888 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1889 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1890 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1891 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1892 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1893 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgagccgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1894 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLSRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1895 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1896 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1897 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcactgatcgtcgaggatatcggcaaagatggccgtattgttcaggcgatcaaccaagtggttagcagt

SEQ ID NO: 1898 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIVEDIGKDGRIVQAINQVVSS

SEQ ID NO: 1899 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaaacaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1900 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1901 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtgtcggctgttgcgcgttatggtgcgaaggcgcgtctgaccgacaaagaggaagtgctgcagcgtgttaacgcgagctgcgagtgggtggcgaacgcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1902 - protein, 562 aa, Artificial Sequence
  Variant of Tyrosine Ammonia Lyase from Stanieria cyanosphaera
MIIASQTQTFTSKSPHTASDSVVTVGDKPLTINEVSAVARYGAKARLTDKEEVLQRVNASCEWVANAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1903 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaaacaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaactgctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1904 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQLLSPRTRQLYLAIKEVVGKAPSKDRPYIWNDNEQALDEHIALIAEDITKDGRIVQAINQVVSS

SEQ ID NO: 1905 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgtgcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaactgctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1906 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGACGIRLELIQRIETFLNAGVTPHVCEFGSIGASGDLTPLAYITGALVGLNDSYTVDFNGEEMTAPEALKLLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1907 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttagcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcagtcgatcaaccaagtcgttagcagt

SEQ ID NO: 1908 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFSSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQSINQVVSS

SEQ ID NO: 1909 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggcggctgttgcgcgttatggtgcgaaggcgcgtctgaccgacaaagaggaagtgctgcagcgtgttaacgcgagctgcgagtgggtggcgcaggcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccagaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaagatccgatccaagatcgttacagcatgcgttgcctgccgcagtataccggcccgattgcggacggtattgcagaaatcgcgaatcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtcctgttaacatgggcctgaagggtctgcagattaccggtaacagcatcatgccgctgctgaccttctacggcaacagcctgaccgatcgtttcccgacccacgcggagcagttcaaccaaaacatcaacagccagggttttagcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1910 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEDPIQDRYSMRCLPQYTGPIADGIAEIANQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFSSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1911 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1912 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1913 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcctgggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1914 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1915 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcgaaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1916 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKASLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1917 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1918 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1919 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1920 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1921 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcaccggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1922 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1923 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcctgggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1924 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1925 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcggttgaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcaccggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1926 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAVEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNSLTDRFPTHAEQFNQNINSQGFGSANLTRQSIEIFQQYIAIALMFGVQSVDLRTKKIANHYDASQCLSPRTRQLYLAIKEVVGKKPSKDRPYIWNDNEQALDEHIALIAEDITKDGRIVQAINQVVSS

SEQ ID NO: 1927 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttacggtgcggaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1928 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAEASLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1929 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1930 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1931 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1932 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1933 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1934 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1935 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1936 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQYYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1937 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcgaaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcctgggcaactcgctgaccgatcgtttcccgacccacgcggagcagttcaaccaaaacatcaacagccagggttttggcagcgcgaacctgacccgtcaaagcattgaaatcttccagtactatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1938 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKASLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNSLTDRFPTHAEQFNQNINSQGFGSANLTRQSIEIFQYYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1939 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcggaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcaccggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1940 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAEASLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNSLTDRFPTHAEQFNQNINSQGFGSANLTRQSIEIFQQYIAIALMFGVQSVDLRTKKIANHYDASQCLSPRTRQLYLAIKEVVGKKPSKDRPYIWNDNEQALDEHIALIAEDITKDGRIVQAINQVVSS

SEQ ID NO: 1941 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1942 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKKPSKDRPYIWNDNEQALDEHIALIAEDITKDGRIVQAINQVVSS

SEQ ID NO: 1943 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1944 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1945 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgtctgggtgcgaaggcgcgcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcaccggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1946 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARLGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNSLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1947 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttgaagtgggtgataagccgctgacgatcaatgaggtggccgctgttgcgcgttacggtgcgaaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggttcggcaccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1948 - protein, 562 aa, Artificial Sequence
  Variant of Tyrosine Ammonia Lyase from Stanieria cyanosphaera
MIIASQTQTFTSKSPHTASDSVVEVGDKPLTINEVAAVARYGAKASLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGSAPSKDRPYIWNDNEQALDEHIALIAEDITKDGRIVQAINQVVSS

SEQ ID NO: 1949 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacagcctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1950 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1951 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1952 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKKPSKDRPYIWNDNEQALDEHIALIAEDITKDGRIVQAINQVVSS

SEQ ID NO: 1953 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1954 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNTLTDRFPTHAEQFNQNINSQGFGSANLTRQSIEIFQQYIAIALMFGVQSVDLRTKKIANHYDASQCLSPRTRQLYLAIKEVVGKKPSKDRPLIWNDNEQALDEHIALIAEDITKDGRIVQAINQVVSS

SEQ ID NO: 1955 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcgaaggcgagcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcctgggcaacacgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcaccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1956 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKASLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNTLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

SEQ ID NO: 1957 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcgaaggcgcgcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1958 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1959 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttacggtgcggaggcgcgcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcctgggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1960 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAEARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFLGNSLTDRFPTHAEQFNQNINSQGFGSANLTRQSIEIFQQYIAIALMFGVQSVDLRTKKIANHYDASQCLSPRTRQLYLAIKEVVGKKPSKDRPLIWNDNEQALDEHIALIAEDITKDGRIVQAINQVVSS

SEQ ID NO: 1961 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttacggtgggtgataagccgctgacgatcaatgaggtggccgctgttgcgcgttacggtgcggaggcgcgcctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaagaagccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1962 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGAEARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKKPSKDRPYIWNDNEQALDEHIALIAEDITKDGRIVQAINQVVSS

SEQ ID NO: 1963 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttgaagtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggccaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttctacggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgtacatctggaacgacaacgagcaggcgctggatgaacacattgcgctgatcgcggaggatatcaccaaagatggccgtattgttcaggcgatcaaccaagtggttagcagt

SEQ ID NO: 1964 - protein, 562 aa, Artificial Sequence
  Variant of Tyrosine Ammonia Lyase from Stanieria cyanosphaera
MIIASQTQTFTSKSPHTASDSVVEVGDKPLTINEVAAVARYGAKARLTDKEEVLQRVNASCEWVAQAVAKGEPIYGVTTGFGGMANVVITPDQAKELQNNLPRYHKAGAGQKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFYGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1965 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcggcagcgtggttactgtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgatggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacgcgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtatggttaacatgggcctgaagggtctgcagattaccggtaacagcatcatgccgctgctgaccttcaccggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgcctgagcccgcgcacccgccaactgtatctggcgattaaggaagtggttggtaaggcgccgagcaaagatcgtccgtatatctggaacgacaacgagcaggcgctggatgaacacattgcgctgatcgcggaggatatcaccaaagatggccgtattgttcaggcgatcaaccaagtggttagcagt

SEQ ID NO: 1966 - protein, 562 aa, Artificial Sequence
  Variant of Tyrosine Ammonia Lyase from Stanieria cyanosphaera
MIIASQTQTFTSKSPHTASGSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPMELLPKEGLAMMNGTAVMTGIAANCVYDAQNLLALSLGAHALALQGLNGTNQSFHPFIHQCKPHAGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRMVNMGLKGLQITGNSIMPLLTFTGNSLTDRFPTHAEQFNQNINSQGFGSANLTRQSIEIFQQYIAIALMFGVQSVDLRTKKIANHYDASQCLSPRTRQLYLAIKEVVGKAPSKDRPYIWNDNEQALDEHIALIAEDITKDGRIVQAINQVVSS

SEQ ID NO: 1967 - DNA, 1686 bp, Artificial Sequence
  Variant of Tyrosine Ammonia Lyase from Stanieria cyanosphaera
atgatcattgcgagccagacccaaaccttcaccagcaaaagtccgcacaccgccagcgacagcgtggttacggtgggtgataagccgctgacgatcaatgaggtggccgctgttgcgcgttatggtgcgaaggcgcgtctgaccgacaaagaggaagtgctgcagcgtgttaacgcgagctgcgagtgggtggcgcaagcggttgcgaagggtgaaccgatttacggcgttaccactggtttcggtggcatggcgaacgtggttatcaccccggaccaggcgaaggagctgcagaataacctgccacgctatcacaaagcgggtgcgggcaaaaagctgccgctggcggatgttcgtgcgggtatgctgctgcgtgcgaacagccacctgcacggtgcgagcggtatccgtctggagctgattcagcgtatcgaaaccttcctgaacgcgggcgtgaccccgcacgtttgcgaatttggtagcatcggtgcgagcggtgacctgaccccgctggcgtacatcaccggtgcgctggttggtctgaacgacagttataccgttgattttaacggcgaggaaatgaccgcgccggaggcgctgaaacgcctgggtctggagccgctggaactgctgccgaaggaaggcctggcgatgatgaacggtaccgcggtgatgaccggtattgcggcgaactgcgtttatgatgcgcagaacctgctggcgctgagcctgggtgcgcatgcgctggcgctgcagggcctgaacggtaccaaccagagcttccacccgtttattcaccagtgcaaaccgcacccgggtcaaatttggagcgcgcagcaaatgctggagctgctgcagggcagccagctgatccgtgacgagctggatggtagccacgactaccgcggcgaacaaccgatccaagatcgttacagcatgcgttgcctgccgcagtataccggcccgattgcggacggtattgcagaaatcgcgaagcaaatcgaggtcgaaatcaacagcgtgaccgacaacccgctgatcgatgttgcggggaacgcgagctaccacggtggcaacttcatgggccagtatattggtaccagcatggaccgtctgcgttactatctgggcctgctggcgaaacacctggatgtgcaaatcgcgctgctgaccatgccggagtttaacaacggtctgccggctagcctggtgggtaacaccgaccgtccggttaacatgggcctgaagggtctgcagattaccggtaacagcatcatgccgctgctgaccttcaccggcaactcgctgaccgatcgtttcccgacccacgcggagcagttcaaccaaaacatcaacagccagggttttggcagcgcgaacctgacccgtcaaagcattgaaatcttccagcaatatattgcgatcgcgctgatgtttggtgtgcaaagcgttgacctgcgtaccaagaaaattgcgaaccactacgatgcgagccaatgtctgagcccgcgcacccgccaactgtatctggcgattaaggaagtggttggtaaggcgccgagcaaagatcgtccgctgatctggaacgacaacgagcaggcgctggatgaacacattgcgctgatcgcggaggatatcaccaaagatggccgtattgttcaggcgatcaaccaagtggttagcagt

SEQ ID NO: 1968 - protein, 562 aa, Artificial Sequence
  Variant of Tyrosine Ammonia Lyase from Stanieria cyanosphaera
MIIASQTQTFTSKSPHTASDSVVTVGDKPLTINEVAAVARYGAKARLTDKEEVLQRVNASCEWVAQAVAKGEPIYGVTTGFGGMANVVITPDQAKELQNNLPRYHKAGAGKKLPLADVRAGMLLRANSHLHGASGIRLELIQRIETFLNAGVTPHVCEFGSIGASGDLTPLAYITGALVGLNDSYTVDFNGEEMTAPEALKRLGLEPLELLPKEGLAMMNGTAVMTGIAANCVYDAQNLLALSLGAHALALQGLNGTNQSFHPFIHQCKPHPGQIWSAQQMLELLQGSQLIRDELDGSHDYRGEQPIQDRYSMRCLPQYTGPIADGIAEIAKQIEVEINSVTDNPLIDVAGNASYHGGNFMGQYIGTSMDRLRYYLGLLAKHLDVQIALLTMPEFNNGLPASLVGNTDRPVNMGLKGLQITGNSIMPLLTFTGNSLTDRFPTHAEQFNQNINSQGFGSANLTRQSIEIFQQYIAIALMFGVQSVDLRTKKIANHYDASQCLSPRTRQLYLAIKEVVGKAPSKDRPLIWNDNEQALDEHIALIAEDITKDGRIVQAINQVVSS

(The sequence listing continues in the following parts.)

What is claimed is:

1. A recombinant tyrosine ammonia lyase, comprising: an amino acid sequence that is at least 95%, at least 96%, at least 97%, at least 98%, or at least 99% identical to the amino acid sequence set forth in SEQ ID NO: 2114, wherein the recombinant tyrosine ammonia lyase comprise a substitution at position 305 and the position correspond to SEQ ID NO: 2114, and wherein the recombinant tyrosine ammonia lyase treats tyrosinemia.

2. The recombinant tyrosine ammonia lyase of claim 1, wherein the tyrosine ammonia lyase further comprises at least one substitution in at least one position or set of positions selected from 2, 4, 4/8/11/13/22/111/504, 4/8/11/17/324/428/504, 4/8/11/22/111, 4/8/22/111/504, 4/17/241/519/547, 4/324, 4/428, 6, 7, 8/11/13/324, 8/11/17/22/324/504/519, 8/11/111/504, 10, 11/13/504, 11/17/22/324, 14, 16, 39, 57, 228, 228/259, 236, 305/307/425, 316, 385, 425, 430, 437, 478, and 505, and wherein the positions correspond to SEQ ID NO: 2114.

3. The recombinant tyrosine lyase of claim 1, comprising: an amino acid sequence that is at least 98% or at least 99% identical to the amino acid sequence set forth in SEQ ID NO: 2114.

4. The recombinant tyrosine ammonia lyase of claim 1, wherein the recombinant tyrosine ammonia lyase is thermostable.

5. The recombinant tyrosine ammonia lyase of claim 1, wherein the recombinant tyrosine ammonia lyase is resistant to proteolysis.

6. The recombinant tyrosine ammonia lyase of claim 5, wherein the recombinant tyrosine ammonia lyase is resistant to at least one digestive tract protease.

7. The recombinant tyrosine ammonia lyase of claim 6, wherein the digestive tract protease is selected from chymotrypsin, trypsin, carboxypeptidases, and elastases.

8. The recombinant tyrosine ammonia lyase of claim 1, wherein the recombinant tyrosine ammonia lyase is acid stable.

9. The recombinant tyrosine ammonia lyase of claim 1, wherein the recombinant tyrosine ammonia lyase is acid stable and resistant to proteolysis.

10. The recombinant tyrosine ammonia lyase of claim 1, wherein the recombinant tyrosine ammonia lyase is purified.

11. The recombinant tyrosine ammonia lyase of claim 1, wherein the recombinant tyrosine ammonia lyase exhibits at least one improved property selected from: i) enhanced catalytic activity; ii) reduced sensitivity to proteolysis; iii) increased tolerance to acidic pH; iv) reduced aggregation; v) decreased Km for tyrosine; vi) decreased immunogenicity; or a combination of any of i), ii), iii), iv), v), and/or vi), as compared to SEQ ID NO: 2114.

12. A pharmaceutical composition, comprising the recombinant tyrosine ammonia lyase of claim 1 and a pharmaceutically acceptable carrier and/or excipient.

13. The pharmaceutical composition of claim 12, wherein the composition is suitable for oral administration to a human.

14. The pharmaceutical composition of claim 12, wherein the composition is in the form of a pill, tablet, capsule, gelcap, liquid, or emulsion.

15. The pharmaceutical composition of claim 12, wherein the composition is coadministered with nitisinone.

16. The pharmaceutical composition of claim 12, wherein the composition comprises nitisinone.

17. The pharmaceutical composition of claim 14, wherein the pill, tablet, capsule, or gelcap further comprises an enteric coating.

18. The pharmaceutical composition of claim 12, wherein the composition is suitable for parenteral injection into a human.

* * * * *